United States Patent 9,976,180 (METHODS FOR DETECTING A GENETIC VARIATION IN SUBJECTS WITH PARKINSONISM) - sequence listing, part 27

SEQ ID NO: 388 - DNA, 834697 bp, Homo sapiens
aggcagacaaccttttcttttttatttcgcttagacaaaatgcaaagagtgtctcattaaattaaaaaagaaacaagagagaaaaccaaattgattccccccaccccttcactgacggcactcatcctaattaacaacaaaagaagaccaaattgagaacccggtttctaatgggaaagaaaggtgtgcaaacgtgactgaagttttcccctgcccgcaaatcggtgttccttttaaattcacaaataggctgatttcccacccaccctgttttctttcttgcctcttgtgtgatagaacttccagtcagaaggtttaattaatcccccccatgcacttttgtagaaaatcagtaaaaatgcaatagcctgtgaagatcataaaactggacttctttcccaaaaaatcagatgcccaggcggatggagctcacactcagacagaaaaaaagcaggagagtctttgcactgtctgtggtttcagtattttctcttttttttttttaatatattttggcaattttctttaattataaatattggaattccgtaaaaaaaaggtagctttgattgaattgtttgaattgtatttacaaccgctgtccagtcatgctgtctgttataccagggtgtaagattttgcgtaaggattgtttcctttcaaatggccccgggagtcgagcagtgattcttgggagctgctcattttagctgcctgtcccagctctgctccctcccgctgaggtaatgtggccacggcccccggctgccacgactgtccttctctcgtggaggaggcggaggaggcggcttccatcgggatgggctccaggaccgtggggcgcttcagggtccggcttttctgaggttccaagcatgcttgtcctaagctcaggtccctgctggtgcctggaccacctcggtttaacaaaaagtccattctaaggtatggaggcaaatgtatgaggtcacctagaaggaaagacagggtagttagttggtgtcttcatttggtaaacatgggcagaatgtcctgtgtgcacacgggaagccatgcgggctttagagatgagaatgccgctgcacacaggtgcctttctcaagatcctccttcagcgctcaccacaaagacaggtggaatcgtcctcctacctcctccctgggcgcgggaggagctcattttcctacagtacttacttacttgtattaacttacttgtacagaaatggaggaatggaggtaacagaatccttcaacacaccatcgttgaaagaaaaacatacatcaaaggcatcagtgtccactgggtacgaacggtgatagaccaaaccccgcatgtgattggaagtacagggagagcacagggtttgaggagagagccagggacgccaagcgaagatggacagctggctctcgtcctggcaattctatgaaaccttgtgaccttggccagccacttagttatgggtcttcatgatggctttgggtgaaagcgccacagcttatggccttcttaccaggccctgcctacctgctaacttctgcgtggctcttctgtttcagccatgctgtgtatagagatgacagcagcttagaccagaattctagtgtttctacttcctgcttatggtcactctggcttctgtggtgccacgcaaacataacctcaggtctccttcaagagcatctgctggctgggcacggtgtgcctcatgcctgtaatcctagaacttcgggaggccgaggcggaaggatcacctgaggtcaggagttcaagaccagccaggccaacatggcaaaaccccctctctactaaaaatacaaaaactagccaagcatgatggtgggcgcctgtagtcccagtactggggacactgaggcaggagaatcgcttgaacccgggaggaggaggttgcagtgagctgagattatgccactgcactccagcctgggtgacagagcaagactcaaacaaaacaaaacaaaacaaaacaaaacaaacaaaaaacccaaaccaaaacaaaaaaaccaagagcatctgctgcaggaagggaggcatgtgttctctgggatgctgcaagccaatgacaagcgtgacagggcttttctcatggccgtccccgcccgatgcaggatctccctaacaggcatcctttgctcagggataccccatcagcctcactgcagccttctcagaagtgcaccgcagcctgacgtgcctccaaccaatccctccttcgccttctcctctcacaggtgtcggacctctgttatggtctccagactctccttgccacctcctgcttccttttgcttccttcttcacaagaatttccccaataaattccttgtgtgtctaatctgtcttgctaggcgcttctcaaaaacctgaactgacacagcttctttcaccatcagctactgaaaggtcaccctgacctctcattgccaaattctctggtttcctcttcgtcctcttcctacctgcattactatagcatttgatgccgttgatatttttgttgttggccctttcagctgccagggcactgtggtcttccagatctctgcctacatttctggccaccctttctcactttccttgactggatccttttctctgtctttcctctaaatacggagtgttcagtggcctgctctcaggcctctctcggaaggcttggctgctttcctcattgctttataaataacattcccatctatcttttccattttgctctttctcctgagccctagatgtgaattttaggtgctttgctaggcatttccacacgagtgtccatctggaattctgaaggccacagtctaccaattcagttaatgaaggccaaccccatcccctcccaatcccaaatactgcttctctcctgtgtgctccatcttgtgtaacattatcaccatccttccatccttgaaacctcagaggtttcactgacacctttctctccaggttaattctaccggcaaaatatctcttgactcttttttttttttttcttttttaaacaagaagagatagagtcttgctctgttgcccaggctagagtgcaatggtgcattcatggctcactgtagcctcaaactcctgggctcaagcaaaccttccacctcagcctccagagtagctagggctacagttacataccaccatgcctggctaattattattcttaaaatattctggagacacagggtcttgcttggtttcccaggctggtctcaaactcttgaactcaagtgatgctcctgcctcagcttctcaaagcactgggattacagacatgagccacctggccttgactccttctcattcccatcttcagggccctgtttcaaggctttaatatatcccatcacctccttgcaaagcatgagcacaattagggcccagccaccaggtccactttgcaaccaacactgcctgacttgagctggactgacgctgggtctgagtttctgctgttttggtacagacagtgtgccttatccagcccagtgcttcccactttttgaggaacaggcagacaaggggtatttgtgcagtacactgggatgaacccagggagctgtttctggccaccttgaggtctgaaggactcaccatcttggcacacctgtaactcgtgacataccaggtgcaaaactctgtctagagaatgggctggtggtgtgtggtcctggagcgagggcccagggtaaaggatgtgcagggagagagatatgatgatggtctgagctcaggagcagctgtgggatgtgagagagggaattaaattgtgagatatgaagggggtccaaggaaggtggcttcagagtcaatgacaagtgggagtggtgacagaggagaaggggttaggggtgactccttcccaggctctaagctcaggaaactgtgtggacagtgaaatcactaactgtgaaagggtgtataggggaaagatcgtactttgatgacaaaagatgaagggtttagtttcagacctgctgagtttgatgcagctggggacattcaagacaagatatctagtaggtatttttatcatagaaacgtagctctaggatgactcactgctcgttttctgagtctaaagtaactgaacattcttgtttcttttgcttcaaaatatcccctgctttccttatgttactgtatgctaacaataattaattgagccttcctcatccagcccctttggacccataggccccgaaggtgcaggctgaggggatctgagaccacctgagccaagtgagggctgccattagccagctgctctgctagcggggcaatgaaagtgatatgtgtttagacagtgtttaaagcctgaaccttaggaaacaccttcaagtttacccacagaaaaagaacaaccagcataacagaaggaaaggactattcaagagtataagagaactggcctgtaatccccgcccactttgggaggcctaggcaatggatcacctgaggtcaggtgttcgagaccagccaggccaaaatggggaaaccccgtctctactgaaaatagaaaaatcagctggacgtggtggtacacgcctgtaatcccagctactcaggaggctgaggcaggagaatcttttgaacctgcgcattggaggttgctgcacgattgcactctatcctgggcaacaaggatgaaactccatctcaaaaaaaaaaaaaaaaagtataagagaactaaaaataaatatggccaaatcaagccctaaaaatgcattttatacaatttaaatgagcatacaaattttcaaaatgttattacccgtcttgaaaatttttttccgcgaacaacaggagcaatgaccttatttttgggaaatgcagcaaatgatttctttgtcattgtgttattacattgttgcaccacttgggatttatgattcaaaactccatttagctttttcaggatatctttattctactaagtgatgatgagtagttatatgatttcactgggaatggcagcatgtaattcactaaatgaccccagcgacactggactgggctcactgaaattaaaggcattctaattcaacgttggcttcctactgtcaactggatccaagggaagctcagtaataaatacctagacaataaatgggccataacattttttttttttttgagatggagttttgctcttgtcgcccaggctggagtgcaactcggttcgccacaacctccacctcccggttcaagcgattctcccccctcagcctcctgagtagctgggattacaggcatgcaccaccacgcctggctaatttttgtatttttagtagagacagggtttctccatgttggtcaggctggtctcatattcctgacctcgggtgatccacccgcctcagcctcccaaagtgttgggattacaggcgtgagccaccgcacctggcccataacattcttataggaaggaattacataatttggcattcttgtaaaaagggttttggtaacttgatgcatctgaactttggcttagaaaaatataatggcatgaggcctacccattatagacactaatgtggagggttcaggaatctcttgccatatagaatagctttgttcctgaaagaatttgagtttttaaaactttatgaaacttgatggcattgaaaattactaatgttcgtttatggtagttattcttcagtcttctctaaccagggattatttgcaaaaaaagtgatgaaagcattaacagagctgtcattaagaaaaaattgaataattcttttgtaatgtgaacatccttttgtatgtgaatcaatacaccttaattgaccagtcttgcgatttgtagttttatacattcaatctcctgaaagtgattatgtctttattcctaagaatctgataaacaaattgttaattttattatttatttattttaaattttaaattatttttattcaatattatttttatcatgttgtttgtatatttgaggaaatgggacagacatttacctccagggttctttaaatatataggtcaagaatgcctcatgctctttctgagacccgactcaatcacgaacgcttgacatatttgtaatgtgttgcaacagatttggggataaatctctattttagtgactccccattgaatgcacagggcttattaaacctccacaaagtaatagcattgtggtcccggctggactgcagaatgcgcaggtcttagattggaaggaagaaacgtgtttgaaatcaaaagataggactcataatatctgcatcctgcctgcaggggctcccacttcagatgtagttatcaagagggctccagtcactgaaatggacagatgagaaataaaaatccttcctaatggaaacagctcagtgttacatctttacatgcaatgcctacatgtatttgtttattgcaggtctgacaagtatctctgaatatccaatatctctgattgatccagtttttcaggcaaagctctacaaagttgtgtgattctctaattagctcccttcaacaatgtgtattttctgattagcgtccaaagtagccctttcaactgtgtgcgtgctgcaaatgagttctctcaataattaatgcacttacagagaagagagcaccagagtagtcagcggtaagctctgttattacaggcacttatgttctttaaaaccccagcccatgtgctcatcaacaaagcctctgaggacctggattctctaattgtcctcctatatgcttaagatgcctacacatagcaagacaactcatgcagttattgatccagaaagagacacatgatgtgtgagactgtggtgaccatggggacattggcacagcattccccagtgccctgcctgccatctgcctgtgtcacatgggagaaaccagcccttggctttaattgtggtgatgaggaatagaggccaggataacattgcctgcatttatctgacaggtctagatctgggctcagtttccttatccataaaatgggagtaatagcagaatctagcatagagggctgtggtgaagagtaacttagataatgcatgtgaaagctttccctggattaaggaatctgtttccacagggagcagggccttcttgggtgtgtctggtactccccagctcacctgccccacagcttaccattcaggaccctctccagttctcccatgcagtgaaaagtagcagggatccagaagaagtccaaggatcctttgtgctttgaactccagggtcaccatattgggtcaccatgtcatgggtactcacctccactgggtgcaaatgccctcggcatccctgtgtgtaaatctatcattgccataaacactggcaaaggcaaatgcccagtcttagtacttgtttcagtaaaaccagctatgacaaaattcacttatatttttggcaatgatttccatactctatggtgtcacttcacttcctctgctttgcttccctcaacctttctccacatttccccccttccccttctccctccttctttcccttcctcctgtctctttatctctttctctcattccctccattctttcctttattttccttctaatatagtttggctgtgtccccacccaaatctcttcttgaattgtagctcccataattcccatgtgttgtaggagggacccagtgggaagtaattgaatcatggcagtggtttcccccatactgttctcatggtagtggatgagtctcacaaggtctgatggctttataaggggttgccccattcacttggctctcatttttctcttgcctgccaccatataagatgtgcctgtcaccttccgccatgattgtgaggcttccccagccacatggaactgtgagtccattaaatctcttctttataaattacccagtctcaggcaacatgaaaactaacttccttccttccttccttcttttccttgttttgtttcccttgtgctaaaacttctatccacgaaatcaaaggcatagaaaaggggtaaaaacatgaagcaggggagggacaaagaggtagctgagtgcaataagacagcaagcagggcatacacatcaagaaaagtgtggtgtgtgtgtgtgtgtgagagagagagagagaggagagagatatgggagggaaaatctaactggaagagcagcatactgaaaggggaagttgaggcatggagaaggaaaggactagcgctggtaggaggatccagctcatggtctgacggcaggaggaactgagcttgaactcacttccatgccctccttctgccctgctcacctacctgcccgcactgccggttccttcccagtgagctaaacccagttagtgtctccagcccaggcccagcatgaatacaaaggctcacagagtcctgcctgggcctttgggacagggtccccctgctgacttctttgggctgtaatggtggatttgcacaccatgaacccactgtgctctgccctgaggccaatgcccttcctgtcagagaccctaagtgagggtgagggatggagaaggtggagatggccaagcacagagaagggctctgggaaactgagttcagggactgagatgcaggaacataccagggtcaggggaggctgagatgaataaggctgggggggtgtgagggaggatggatgagagagaggggaagagacacacagagagagagagagggatcagagagatggaaacacacacagggaggcagaaagaaagaaacgtagcactctaacctgggcgatagagcgagactccgtctcaaaaaaaaaaaaaaaaaaaaagaaaagaaacatagctacgcaggtcggtagacagataaaaattagagacagagtcacaaatagagaagggaaaaggggaacatggtaaccatctgggacagtggtaaggagcagtggaggaagagggcaccagaaaggtgagtactatgagaataaatgtgtaccacccactttgaacggcccttgtggagctttaaagatgtgtgcaccatacaaggaccactggcccatccatcactggggcacccatttctcattcttttctcatcagcctcaccaaaacccagtgcagatcacaggctgcacccatcactgcctttctggagggaacccaggcagctgctttgacttccgccttgaggatgagacgctttacccattattgcagcattttgctttcttatttgacatcatgcttcatttctcatccttctgttgctgccctctggggaccttcagtgccattaatgtctccaaaagttctgattaaataggtcagcattgatttctctctctttctctaaccactttgcatactagtatcacaagctcctccttgcctctggtcctgaaatgtacagattccttctgcaggccccacatccatcagcagattcacactcagagcttgtccccctccactaacggtgcattagaaccatggttggcctgactgtgggaaaactgctgaactaaacctgcctccttttagctgaaacctaggaaagcaaaacttcctgaattttctcaatctattcagacacacgcaaggtttgaatgtatttcagttcttggaagaaggatggcaaaatcaatactgaaataacaagaatgaagcaattcagaaaatggatgtgcattccattaatccatcatcaaacaatggttcttgctatggttcttgctatctcccaggcaccacactaggggaaaatatctgaacactagatcagaggctctccactgagggtggctttgtccccaggggacatgtagcaaagtctggagacattttgattgtcataacacaggggagggtgacactattgatacctattggtcagaggccaggggtgctgctcaacatcatccaatgctcagaatagcccctgccacgaagaatgatctggcttcaaatactaacggtgctgctgttgagaaactctgttttagatgatcagaattcataaggccaagtgttccttatttcactttaattctacttataaagcattgaattcaaccaggataagcagttgtacccctcagcctcagaatactagtccacaaggagttacgacctcagttcttcatggaagaaaataagagatggtccaatggaactgtaatcagaaggcaaaacccccaggtctttctccattggcacccgctgaggcaggagctgattccagtggaaagagcagtagttacagagtgcagggcttggtgttgaaatcctgtctctgcctctgcttctgcctccaggtagttttgtgacccttttgagccttggtgctcttgcctttagacaaatgaatgaggcacaatacattctttttttttttcttatatctaaactttttattagcaacaagtaatatttaccaaaagtattgagttggatgtattttagcagtattttcttttctttttttcttttattattttaagttttagggtacatgtgcatattgtgcaggttagttacatatgtatacatgtgccatgctggtgtgctgcacccattaactagtcatctagcattaggtatatctcccagtgctatccctctcccctccccccaccccactacagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtgttccatggtgtatatgtgccacattttcttaatccaatcattgttggacatttgggttggttccaagtctttgctattgtgaataatgccgcaataaacatacgtgtgcatatgtctttatagcagcatgatttatattcctttgggtatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgttttttctcaggttggtcaaagatcagatagttgtagatatgcggcattatttctgagggctctgttctgttccattgatctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtaccttgatggggatggcactgaatctgtaaattaccttgggcagtatggccattttcacgatattgattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacagtggggttttctagatacacaatcatgtcatctgcaaacagggacaatttgacttcctcttttcctaattgaatacccttcatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtctgccagtattttattgaggatttttgcatcaatgttcatcaaggatattggtctaaaattatcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattgttgccacaatttcagatcctgttattggtctattcagagattcaacttcttcctggtttagtcttgggagagtgtatgtgtcgaggaatttatccatttcttctagattttctagtttatttgcgtagaggtgtttgtagtactctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttgcttcggttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgcgtcccagagattctggtatgttgtgtctttgttctcgttggtttcaaagaacatctttatttctggtttcatttcgttatgtacccagtagtcattcaggagcaggttgttcagtttccatgtagttgagcgattttgagtgagattcttaatcctgagatctagtttgattgacctgtggtctgagagacagtttgttataatttctgttcttttacatttgctgaggagagctttacttccaagtatgtggtcaattttggaataggtgtggtgtggtgctgaaaaaaatgtgtattctgttgatttggggtggagagttctgtagatgtctattaggtccacttgatgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggcttaaagtctgttttatccgagactaggattgcaacccctgcctttttttgttttccatttgcttggtagatcttcctccatccttttattttgagcctatgtgtgtctctgcacgtgagatgggtctcctgaatacagcacactgatgggtcttgactctttctttatccaatttgccagtctgtgtcttttaattggagcatttagtccatttacatgtaaagttaatattgttatgtgtgtatttgatcctgtcattatgatgttagctggttattttgctcgttagttgatgcagtttcttcctagtcttgatggtctctacattttggcatgattttgcagtggctggtaccggttgttcctttccatgtttagtgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgcagcctacagaggcaggcaggcaggcctccttgagctgtggtgggctccacccagttcgagcttccaggctgctttgtttacctaagcaagcctgggcaatggcgggcccccctcccccagcctggctgccaccttgcagtttgatctcagactgctctgctagcaatcagcgagactccatgggcgtaggaccctccaagccaggtgcgggatataatctcgtggtgcgccatgttttaagcccgtcagaaaagcacagtattcgggtgggagtgacccgattttccaggtgccgtccgtcacccctttctttgactaggaaagggaactccctgaccctttgtgcttcccgagtgaggcaatgcctcgctctgcttcggctcacgcacagtgtgcgcacccactgtctggcactccctagtgagatgaacccggtacctcagatggaaatgccgagatcacccgtcttctgcgtcgctcacgctgggagctgcagaccggagctgttcctattcgcacttattttccattcttgcccttagcaaatcaaaaagacatctcttcaacagataaaggggtgctctcccttgaaatgaggatagctatccacaaagcaggcagcattatctagctgtaattttaatgctacctgaattttgaatttgcctgtacaattacaagtcctaaaaatgcagcaaattattgtcttcttccataagggatgactattcccatctctacaaacagaaaacaaaattctctattcttttgagaaatagctgcaaagtttaacaattttttttcctctgggtcaaggtggcttccaattcttggtttcaggtagcattttgagccagttgcaaaccttcttggattactgcttcttcttcttatgatgtttatcctgtgccgtcaagagaagccattacatgaagctacttaattcagtttcaagtttcagacatgcaccctaacacagcctgccccactagtggtagggaaagcatcagcccctttggatctctgtgctcatgccctctgggccccagacacaaggttatgagtttcagccccttccttggggaatgcatttgaggttgttttttttttttttagtgggaaaaggccactgcctggtgccaacttgttaattcactaaattgccagtaattcgaaagagttactggattttaattttaggatccattcatcttgcatcactctctcctgagggtgtgagggtggagagtaggaggcgggccccaaggcatgcagagaggccaggagcccttacctgaagaaagagcctacctctgcacaggtcagcactattctgaccaaggctggccaccgtattctcagttgtcattttgaccatgctgttttccctctctgaagtctgggtatctgtcatgttggctctgaaatcaaaacaagacaccagcagtccaatcttcagagctaaataacccccacccccagcttcacttacctatatctccctcactgcctgaggacttggctcaggcagctggggtgccaagcctcggggcttgcatcttcctcctctgttctgcacatcactaaaactcagttttgaaatgtttatcataaatattatactaagggtctcctttcaaatgcaagtctctttgatgcctacacgtgtgcttgcgcacacacatgcgtgcacacatacacattcacacacaagtacacatgcatggacacatatatgttgacacacatgcacatgtacgtggatacataagcacatgctcccatgcatggatacacacaggcacacacacattctcactgcactgctctgcgttccacccttctagaggaaggcttgctccctccctctcagcctccctgctcctctgtctttttttgccatgcgtgtgttgagtggacactaaatgactggtcctgttttgggaactgaggatgcagtgattgatagacaagacccacagagatccccactgatcaagtaaacaaacaaatagtatcgttcccgactgtggtgagtgctgggtggagaagcaaatccaggaaggggataaaacgtgggaggggagtattttggaaagaatggcccggaaaggcctctcaggcaatgagacgtaaatgatgggatggaaggagccctgcaaagatccttctggtggtccagagagctgagcaaagataaaggccaggagataggaatgagcttggcgttcacaacagggatcaagagttccctctgaactacgacccttcaaacactcccatagaattttaggttaaaagaaccctggggccatccaacaaagcctccacatactgctgttcacgcccactcgatgtcgacctaaatattggcatgtgctaatcctgatttctgctggaaatccaggtctctctgaggagtatttgcaattttagcttcttaagggctcttatagaatttcagtgtcttcttagtaactctccctcagactcagaaagtgacagtaggacctgttctgaggggttctcaagcttagaactctaagccctttgcctgaaataaaagcttagcatgtatgtacatggggtcttctgcagccactaccctgcaaccatcctcctgccactgtgttcaagaggccatcccctgtacctctgaccttgtccggtggtctggctggttcactgtacttgctgcagttgctaagctggtgtttgtgtcctcttgttccagaacatgtattccctgtgttctgattctcttgtctgacttctgagccccttaaaaggctcactgtttttcttgggtagcttattggggttcagttctaatcattgcgaaatcctgggctgtgccagttcctcgagaggtggaaagtgatgggggaggcatgtaccttagagaacagtgatgtgggggtagaggcctctttgtccctgctgagtgaccagaaggaagctcccagattccagctctacagatgacaagaaagaaggctgcccaggctaactgaacgttcactgcatctcagacagacccggttaaaacacaaatatacgacactcgtgtattgaatccctactgattgaatatctcctgagtaaaaagacactgggtattaccctaacacataaaagggttaatatcttaaattaacactcctcacagtctcattcatttatcagaatagtgtgtatcaaagactgcaggcaatgggttctgaagacatgagacaggcaaatcttgagaaggtcaagaaataatacaaagcccagctcatagaagatggtcagtcaccacctacacacacaaacacgcacacacatacacagcccagtgaggccttgtgagaagctaaagccacacgaaggcccagggagcatacagaaaggtaagaagacagcaaagaccatcgtcttccaatgtggcctcctgtacactctgctggcaccagggcctaaggcatcctgtatcccaaaccagaaatgggagacaagccatcatttccagtaagagtcaaccttcctctgtttaacccccttccatggcttcctgctgctctcacagtagagacttactagcgtctgaggggtcagccttgtcttccttgccttgacccctggtctccagcctccaaccttgcccctagtctccagccttcaactttctggcctcctacaactccacaaatataccttccctctgtctggaattctctcatttccagcctaactcagctccttctgtgggatgattcaagatgcacattgttgtagaaacagctctgtcagcttcatggcagaacaaggccaagcccccagctagggttctgcttcaggtggtccccaatgtgtggttccttgtggctgttgtgtgggaactgtatccatctttggatctcatggatcgttccatagtgggtgctccaaaaccactgctaagttctgtgcttgcctaaaggccagggaagattttccaatccgtcttttattcagatctactttatttgagaagaatcataagcctcaacaaagtcaaagccctacttttatacctcggtgtagtttttaaagttcaccagcaagcagaaggatcacaatattgatgagctcttaaaaaatgcatgagggcccctgagtacaagccaagaattgtaatcgagtccctgcacatgggcctctgatatcaatctcacattatttatttagggtttttcctgcttgccgtttgggagtgaagattcatttaccaagagagattcttttactagttttcattaccatgctgcaacattaatattaaactcaaaaagtgttagatctcgtctgtctctggtatgggtggactctatgctcccctttgggaaccagctctttgacactatagtgttgttgcaagtctggtctctgtgttttttattgaaattgctggaactcaaggaaatcatcttttgcttcttacttttgcatcaatatccagctctatccaggcatagatctcaaaccttgttagaaattgatgaaagttcctttttatgtgtccgcagaggagattgaagccccaaaaactgtgattcacattcattcccacaaatttgggaaagcatcggcatgtttacagcctccaactaacaaagcattgcagaggaggaggaagaaggctaccccaaactgctttggaatatctggcccccagaaatgcatttcatttgttccacccttatccattaattcccaatacagatgtatgtaaccagtttcagtggtgagatacctcagagtataagaagggctcttttaggcttcaaggtgcctttagaaagtattgtgcctgggggggaggagccaagatggccgaataggaacagctcccgtctacagctcccagcctgagcgacgcagaagacgggtgatttcggcatttccatctgaggtaccgggttcatctcactagggagtgccagacagtgggcgcaggtcagtgggtgtgcacaccatgcgcgagccgaagcagggcgaggcattgcatcactcgggaagcacaggggtcagggagttccctttcctagtcaaagaaaggggtgacggacggcacctggaaaatcgggtcactcccacccgaatactgcgcttttctgacgagcttaaaacacggcgcaccacgagactatatcccgcacctggcttggagggtcccacacccactgagtcttgctgattgctagcacagcagtctgagatcaaactgcaaggcggcagtgaggctgggggaggggggccccccattgcccaggcttgcttagataaacaaagcagccaggaagctcgaactgggtggagcccaccacagctcaaggaggcctgcctgcctgcctctgtaggctccacctctaggggcagggcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggttgggttacccacaaaggaaagcctatcagactaagagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggccggccctaaaagagctcctaaaggaagcactaaacatggaaaggaacaaccagtaccagtcactgcaaaaacatgccaaattgtaaagactgtcgaggctaggaagaaactgcatcaactaacgagcaaaataaccagctaacatcataatgacaggatcaaatacacacataacaatattaactttacatgtaaatggactaaatgctccaattaaaagacacagtctggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagacttcaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatacacatttttttcagcaccacaccacacgtattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaagctagaaataaagatgttctttgaaaccaacgagaacaaagacacaacataccagaatctctgggacgcattcaaagcagtgtatagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaagaaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaaccctcaataaaatactggcagaccgaatccagcagcacatcaaaaagcttatccaccatgatcaagtgggcttcatccctgggatgcaaggctggttcaatatacacatatcaataaatgtaatccagcatataaacagagccaaagacaaaaaccacatgattatctgcatagatgcagaaagggcctttgacaaaattcaacaacccttcatgctaaaaactcttaataaattaggtattgatgggacgtatttcaaaataataagagctatctatgacaaacccacagccaatatcatactgaatgggcaaaaactggaagcattcccttgaaaactggcacaagacagggatgccctctctcaccactcctattcaacatagtgttggaagttctggccagggcaattaggcaggagaaggaaataaagggtattcaagtaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaattaatatcgtgaaaatggccatactgcccaaggtaatttacagattcaatgccatccccatcaagctaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagaacaatggaacagaacagagccctcagaaataatgctgcatatctacaactatctgatctttgaccaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataagcatgggtaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgtggcattattcacaatagcaaagacttggaaccaacccaaatgtccaacaatgatagactggattaagaaaatgtggcacatatacaccatggaacactatgcagccattaaaaatgatgagttcatgtcctttgtagggacatggatgaaattggaaatcatcattctcagtaaactatcgcaagaacaaaaaaccaaacgccgcatattctcactcataggtgggaattgaacaatgagatcacatggacacaggaaggggaacatcacactctggggactgtagtggggtggggggaggggggagggatagcactgggagatatacctaatgctagatgaccagttagtgggtgcagcgcaccagaatggcacatgtatacatatgtaactaacctgcacaatatgcacatgtaccctgaaacttaaagtataataataaagaaaagaaaagaaaaagaatatgaactaagaaaaactaaagtctaacaggggaaacgtgtcagaaaaaaataccaatgtaggtttttgaatatgtgaaggaaaaactgattaaattatgcagatgaaataaaaatcaaaaaaaaaaagaatggaaaataagtcactttgattaaagctactgaaagttggagtagatttaaatgtccttttgtatttatttgactataatttctattaattgaaatattttaaccaatttaaccagttggttttgttgtcacaagcatgatatattcattcatacagtaaggtttatgaagcatctactaatgtgccagacacagtctggccatatatgtgtatattataaacacacacaggagatatatatatttatgtatagagagagagttttaagtatgtagtattgagtattcaatactattaattcatttaaaaataattcttgcatgataactacttggctatcaggtatctgctagaccttgagaaggaagtatgaagataactaagacatatttcctatttttctgaagccacagtctggccaaattcatgtaacttgatggcaatttgcagagaatttcaaagtctggggatcataactatttgtactgaagacagaaaaaataaaaagggaaagagaaaaaaaggaccatcagaaaagaagctctaaagttgaggaggaagaaattgagagatttggaagactataaacagaaacagacatgacgaatatcatctagcgtgaagagggcatatagggaaagaatgtgatgtaaaagcacagctctaggagctgctaattgtatcacaagctctagttagcagaatagtaaactgcaaccttgtattttgtgcccaatgttgaatttagttgaattataaaggagcgacggaaaggtttccaaaggctgaaatattttctaaagcatatcagatgttcagtaataatgcagtcatctagggtagacaaaacaaagtttgtggacatttgaacttgcattgatttaagagattattcaaacctatatttataaaatcattttactctgaatagtctatgaagacaatagtaacttagctatgatcttccattgctctaatgggtccaggtcacaatatcatgagcaaaggtcaaatttttaagaaacaatccaacaatatgagcagcgtgccatcaaaaacaagcttcaaccctgtaattatgtaaaggcctgcacaaataggacagtcttttaacctagaagctcattctgtgccctaaatcacacacaaagggaaaatgacggcatgctatctcaggtggaaacataaagtacttaactgggtgacacacaattgaggtgggtacctgctaggacttcagtggtcactggagaaaaataaaagcaagaaggaagaggaggtcagcagtacagctggagtcacagtggggattctagcaacccagtgccagaaacaatggctaacatggctgagtgcctcctctgctgaccccttcacctgtataatgctatgtgcatctaacagaagcccagtacacagtcaccaacgccattcccattttacagatgcaggaactgaagctgagaacgcctatacaacatgcccacaggcttatggtcttctctccagtcctcctcaccttcaggctgaagagctgcagaaagtcatggcatttatcctgcatttttctccatttgccttgcaaataaatgccaacaacacgaaaaaaaaaaaatagttgaaataaaaacacccacaaataacagcttgtcttttcccctaaggaggtagacagaatgaaaataaaggaagccatcattctttattggatgctggcatgaatcttgagctggtatggaagattatttgctggataaactattcttattttatatatttttatgcatttataaagctcatttcagctaggccttgtcccataaaacccaagggaattgtagtaattcaaaagtgaagatactttttgaaatggaactagaacagtggtgtagaaaatgggtaaaatgagaaacaaaactggattcaataagattggatagatcagtctgtgaaggaaagtctacaggcaactatttcagggtgaaaaagaaaaagtggttcttcagatgagaactacacttggctgccataggttggattccacctaaagatgggttttatttgccctgtacaatggtttacaaatatccaagccaacactaaaaagctgtgaatttccatataaaaccaagttttccggcttctcttaaaacacaagtccatactaagaccccatttccacttgcgatcagttggcagggccttgctagagtcttttcttttagacagtagtgaaccctgaaatggcccatgtccgcctcgctcctttgaccctgttctctagcctctgcattctattatctgccatgccttgctgacctcaaaatttgcagctttcacaacccggacgattcacaggtgttcaagttgaagaccaaactgctggctgacttaatgttagccagttaccatcaccttgtgtaattcagtgaggccaagtcccaaacactgactatatagtaagacctctcccctttcagaagccctcagtgtggcagttttaaaatacagccctcacatttttgacagtcttctcatcaagcagtgggggcctctttctctggaatcagggtttcttgggctctgtgactgcttgcccaatagaatatgacagaaatgatagctgtgtcagtttccaggcccaacctaaggaaactggctatttccacagactgtatcttggaccatttgctgctagaacccagccaccatgctgtgaggaagctaaagcaccttgtggagaggccagcacagggagaacacagccaggtcggtgagccactttggaagtggatccccagccccaggagagcctctgcagcatggtaccctcactaggtcccgcccaaatttcagattcataaacaaagtaagtgactgctgtagttttaatccagtgaactttgggatggtttgttatgcagccatccataaacagagcacccatttggtctgaacactgagaagggctttcacagcagatgagggaggaccaggaaggtgcacttccctaagcgacggcccccaggtggccttgctcacctacctggccgatgtgcctttggaactgccatattcattactcttcctccatcctgaggtttggggggagatgcagtgaacctgcagattcccgattcggaaggggtgctggaggtcagactgtccgtgtactcatttgtccctgccgtcaactgctccgatgacgtgtctgatatgaagcactccgtgatggtgaacttggcgtgcctcagttgctcttccatcttggcgtgttcgtaggccctggccagttcttcgtaagtggaggaggcactttctgtggagaccatgctgcttcttgctcgatctacaccaggaaagagaaaaacaagacggacgactcaccatcagaagtctgaaccaacggcatggcccttcctggcttggggctgttttcttccagatcatggtgggacctggtaggagttctggctccttggcggaggctcctgccttaggcactctgaggccagcttcacaagtctcagcagatccggttaagggaagctttgttgcaaccaaattgctgtagtcagatgtcccagcttgggacatttccataaataaataacgccttccctttaaaaaaaatcctgcttttagtgaaaacagtaggagccaggcagcagccccctctctgctccaacctgcaaatggatctatgccctagagactctttaattggcatgaatgatttgagctgcagttcagcttctggggcctcagctcaggaaggaagatgtgatgatatttagaaataaagatgtcatgttgcacggaaattggccacaagccagaatggcccccgacccctgggatgcgtcttctgttgtgattaccctttatggggactagaaaaccatcaggacaaaaactggtgcccacatgcctttgagctgggccacgccatcttggtcagggagatgtctgcgtttcaaatgcactaaaaagttttagggtctcctctgtgtggaactctgagactcttctaagagaaatcacagccttaaaaataaattcacatggcgatgatcctcctctggaacactgtttttgaagtatatcatcaagaacaaaagaaaaatgagtattaaaatttcctacagctattagattcagatgtaatttcttttcaaaatttaagagggggtggtgggcaacccggtgctattcttagggcctgtcttctctctgaagtgaaaacttggtggttgatggcatagactggatgacttaccttataaccaacccctgtttaattgtcaaacggatcagcctgtgttccctatagagggtgctatgacctcatcatgtaacttcaagtgctgtgtcttaatcttggagatggtaatgggtcagacgccctcagagtgtaatcagcaattactgcaatcacgggggtgaaaatttaaaaatgtctctatttctcccagtggggtaggaactaaatggagaaataagcttgggtctaagattcaggacacctgcagaatagatgcagtttggctctgttttgccctgtgtggagtaaaggctgtgcagttgtattagtaactgttagataaaccgcgtaacaatttgaaagtgaccttcaaaagaacataagtaagagggaggaagccctctctcccctccccaaggagcccatgaagctcaaggtgcgggggccgtgctggtccccagggacggaggaggcagcgtcagggcctacctgtgtcttgcgaggggctgacgctgtaactgtcgctctctttgtctactgatcctgcagccctgggtgttggcagcctccagtctgtggtgagggtgtgtgctgagatggtggggtggggtcggttgagggtccactggctggcatagcggtttctcgctgtgggcccagccttggcattcctcctggtggtgggatctgtgaagagccaagaatcatgtctgcctttgtctgcaggagtgtggtcagctgagagcaagcgtagaggtcagtgccacccacccagcactgccgactcgcccacgccctccaggaaaacttccttgacttctcctgtgcagaggatactttccctttcctttatggcttgaaaccttcatctgatacttacgtgtttaatcagccctgcagggaaaagaacaccctacttggattcagaagttacatatttgagtcttgctcttggcctttaataatgttatgacccttctaacattaaaagctagaaatggaatgaggggagactgacaacaattacaggacaaaacaagaaaatttcaaacagtgatgaagattataaagaaaatgaaaccaattactgtgctagagaatgacttgagagaggtactttggttacgatgtttgcaactgcaattaaatggatgatagtacaaaaaataatgttatgacccgatgcacatcatttaaacttcctgggcatcgtcatattctgtaaaacaaggaagctcagcccagtgtgttctaacatgacctcctttctacatccttaggtgttgttatgcgtgaatcacgtccccccaaaagacatgttcatgtcctaacccccaggacctcagaatgtgtgatctggtttggaaataaggtcatcacagatgaaattagctaagacaaggtcatattggaatagggttggcccttaatccactgtgactggtgtccttttaagaagaggacacagacacaggaggggagagggccatgggatgatgcaggtggagactggagtgctacagctgcaagcaaatacatttctgtgctgtgaagccacccatttggtggtactacgttaaaacagctctaggaaattaatacagatgttgcctgtatttttgtttctcatattactactcattgttttaatgatgactgttttattcattaagttgaaagctcctaaagcagagggaccatatttttatgtcccaactctccttaaggccttgcctatgatagcacatctcttcaatagaattgtcctaactttaacagagacaacttgggttatttaatatggagaacaaagggttaagctggtgccagatgggtttcattttctctaaatctggaaccaaaggcagcaagtctatggggtggacggagttcttagctcaaccctttggtgaggtaagaagaaggatgttccaccagcagagactgtcaggtaccagaatgggctacaacatcgcctcttctggaattctgtggaaaatgagagaggttcagttacctggaatgatttttctggggctccagcctggagacagcttaaggtcctagatgggtcttttctacctttgaattctctgcttctcaaagagcagtttgatacagttatatttcagtatggtctggccacttctaaacccagcagactgtattcactgttgggctctcacgaagtttcaaaggagcaaaactgacagggccggcctgtaatgttattgcaccgatttatttatgtgctttcatgagcctggcagtgtctccagggcaggggcaatggtatccctctgtggatccattcatagagcctacaataatccctgacatacagagttttctgaaggaattcatagacctagggtcactttatgaaggcaatggaagctcagagagaagtgacatagctgttacgtgataaaactataacccaaaccttctgccttttcagttcagataacgcctgttacttgaccacatatggccaaatcctgagtgtctaagtttcctagtgctgtgtctacatgaccttggcttgcttataattccatgttggaatgtgaaaggctaacactgggaaggtgcaatgactttgtttttaaacgggagatttcctcactgcaagtttctagttaattcgactttgaatctaatctatcattctgtgtcgctggagaggtgcgttaagatggcagccaaagagatagattttaagatctcctaaatcatcagaatactcaatcttggtaaatattctctggggcattgattttaagacacatttcatcccttacttgcacaattccacggaagacttcattagattttttttgtccttgatgagaatgtaaatgagttatgttggagctctacacaaccaggtatgaatgataattgggtttcttcaccgaaatgctaggaaagaggccctcaaaaagacagaaaaacattatgatggggaagaggctaaatgtcttccaggcactatcgacttgataagtggagcttaaataagtgaagcttgttatttaaatgctaatgagtcttttccagaaaattacccagtcccttacataagttttgaaaattctcatttttattcttctttaagtttcttgcaactacaactgttgtagctcattctgagcaggtttacttctggcatggaagttggggggtggttggggggtatagtttgctagtcccacttcaaggatacagtcatttcctccaatcccccaaaccttgaccctcatttcttctgcttgagctcactctccaatggtggggcaaagatcttcactgtcatagcccctttcctcattgagatcaccctacttggaaaattccatgggaaagtcgcacatgcagccttgattcaaagcctggtctcttttcaagttaattttgttcataatctctttttttctagatgaggacagttttactggtggcctgataatgttgaaaatttaggtcatgatattagtttccttaaaccacagccctcagttctgtactgcgctaggcaggcatcctagggtcaaaattgcctcagtatgtagaatactggggtatttgacacatttattttttaataatttggtttttggagccattgttttgtacctgaactgaactctgctgtatgataatgactaagatagcagctaaaatataatttttacttggattccacaggaagccttttttgtgtaacttactagctcatctactgagcaaataaacgctgggatttactgctccttcatggaaagtattttgttaggctcccagcattctaatataaataaaactcggtgattaagcttcatgcctgctcagcagcccatgagttggagggcacaggatataaatagctcatggcctttcaacatggggtttgaaccctaattaagcttctgcccattgaatcagattattttaattatcctgagtttgggatgagagaggattttgtagataatataataggttacagaacatgtcatgcgtactgtgatcatggtattaatctgctttcatctgtgccattggtttccatatcttgcagttgtggaggtccagctttacataacgaatttactagttgtctcagagagaggatgaaactgggagatctgaacactccctcatgtaactaaaaaatatttatctagcacttattacatcctggaccactggatgcacctcacccaccccaggtatttccctcagggccactgctagtcccatcctgggtaacagagggcattttttctttcaaagtctcagcaataaagattcaagtccatgttgtaagctcttgtcattgaatgtgcgtacatgtgaagtctattctttagtctctacatattctatatgtagtatctctacctaaaggccatgtagaatgactgagagtgagagctttggaattaggctgcctgggctggaagttcatattcactactccctggctgtgtcgctggccaagtgaccttgtcagacagacctgactaatcccctagtctctgagactaggtgatgtcatcacccacgttaagagctgtcctgaagtttaaatgagattaatgtgcccaagtgctccgggcacatggcacaggcacagctggccgtgcccatgattcctatgcagcaaacatgactcaatgtcttttcttttccattcccattgttctgatctcagaacttgatggctgattggtatttatccactacatgcctgtgtcagacactgtggctggtatggggatgaggacatggatagagtcctagttttccagtgtattataatccacaggaaagacagagaagtaatcagtgcagcagaaccagccaagggatgtgttttcactactgacagagataaatagcaaattgttatgatttcttccatcctcataagaatctgttgcaaccctctggcaaactaataaaatgcctagaaacataacttctacaatgcagtcattctggtatgcaagcaacatgttttagatgcttttcttaaaaataaagaattcttgcaatgacaacacagtcctaacatacaaaatagaatcacgatgtgttctctagctgagaaaatagagaatacaaatgattctctgcaagtatgccaaactgtggtgagaagaaccggctccatggaattcacagaggtataaacacctgggcagaggtgagaagctctggtgcaagaagctagtgggggactgtgcttcagaaagttcatgggtttcagactcttgaacccactgtggggccagtcacctaccatttctaactctaaataaaacacggagtgttgtcagtccctcacactgtggtttttgaggaagatttaatgaaaaaaatgatccagcagatcttttactaatacagagggttctgcaaatgctaaattaatacgctcaatttggagagtgaggggggaaccagagactgatgcatgcatttgagtagatttgcttgatgttggtaaacatcatttagtgaaattcagcacaaaggacagaaacattgttctataagctatagtgtttccctgtgatcatcaggctaagccccagggacagcatctcagcactctcagaatgaaatgcacctgccaggcactggcttaggggaccctgaaagatgaggacagctgtttctctgtctcaccttttccctgcctttcactgtgctccagtgccacttccatcctcatcatgcggggaaccttgggagcttttccctgctgccccctctgctcctgctgtgactctgatcttgtttcatgtcttcccctcactggaagtcctcctgaatgacttggacccaagagagcccctcccactgctccacacgcccgctgactcaccatggcttcattctctttctgtctaggacttactgagaaatgaaaactactttagttccatgtctaatgtctgccccctgactaggatgaaatgaatgtctttttgcatcttactcatggtgtatctccatcatacagcactgagccatatacgtaaagtgaaacctgaataaatacttttgagtgctgaatgaacgcattaacattcccagccctgcttccaactttatagccatgagatacacacacgtccctcccatgtgcgtcctgcctggcactcgctgaccactggtttacagtatctgctgtgactccggttcatgtctctgttgatattttacatgccaacaaatcaacttccccattattctggggctgaccatgaagctggaaggttgccagtgcttttgttttgggctgctgcttctcctgtcttaactatttatgactagctttatgcattctcggctgctagctgaccattgacagggaagcagaaatgcatgttgctttttacctggcaggaagaactgatgtgccggaggggtcctgccctgctgcgttacatgcaggaaacatttctaacccttggggcagtgtttctcaatgtggggtccaaacggccagcatcagaatcacccagggtgtctgttaccatgcggattcctaggccagaatctctgggtggaggcctggaattgatatttaaataggcaccaggtgattctgatgcatgtaaaggtggagaacgagacccagggcatctgctctgttgtctcttttgcctgctcttctgccaccgtttccaacagaatgctgaagccaatgctgcatcactctaaaaatctaatcctttcaatatctgtaactttttctgatttagcagcaaaaaagtggctcttaaacccattggagcagtgtcttggagtagcagcaagccacaccaggcagttcacaagggagaagccaacggctgaagagatgtcaaagcccttgaatcttttttttttttggagacagagtctcgctctgtcgtccaggctggagtgcagtggcgtgatctcagctcactgcaagctctgcctcccaggttcacgccattctcctgcctcggccttctgagtagctgggactacaggtgcccgccaccaggccggctaatttttcttatttttagtagagacgaggtttcaccatgttagccaggatggtctcaatctcctgacctcgtgatccgaccgcctcggcctcccaaagtgctgggattgagccactgcgcccagtctggatcattttttaagagcaaggctctggcacacacccctttgcaaagctaattcccactcatatcccgtttatgtcttcagaatgtattaatgtgatcaaagaagaaaggcggtaagaagattagacaaaaggaagaggtaaaagacttctttagaatgtagaatattcttgaaaacattttttaaatgaatttcaatgcctgctgaaactgttttctgtatattacaatgttatttcgtaggcaatgggtttacttcataaagctcactgcatttcgcaaatgcttcccaagctaggatttatgaagaatagcttttaacattataatagttatttttctaataataacacactattctaagaatgtaaatttttgcaaagaaattgattagagatttgaaagctagacgtcaaagtttccaaaatgataataatcaggacatcaatttctcagtctttaaagagatttaggaacgattccaattatgaagaaataagagtatctaattaataagctctagatacatattaggggattcaccttcattgcagtaattaatttccatatattatggatgcaaatattaataacaaaatccaacataatcttcacattaactagaattataatttttctcaaacagtgtgttcaggggcaaaagcataagctttggggatagatgggtctgtttctgaatcttggttttactacttatgtgtgcaactttatactgtttgcataatttatctgaggctgcagttttctcatctgcagaatagaggctatgatacctgcttcacgagtaggtatcttacaggattgttgcaaagataacgtgcatgacatcatcgttctatcccaatactggcatacagcagatacacactaaagtagattacttttttccttttctgtgttgcttaaattaaaaaaataaatacatgtacctgaaatttctagcactttttatagtaaccaatactaacagtaattcaactgacataataatagccaagatccatcaataacagctcattatcccaattagggatgttattatacccatttgtttctcaggcataggtatgaaaagccacacattttcatttgagagagaaagaacattactatgttttcagcattgttaacacccacacattttaagcattgttgaccactcactcgttcccggccgagcgtctgaaacatccactaagggcccagtggcctgagacaccgattggtaatggaccgtgtgagtgaccgtcagggacttctgcttagctgcctctccaaagtcagcatccgtcaacagaaccgtggagcgatcatctacaggatggcaggaacacagaaagccaaacacgtttatctcccttccaaccactccctggccttttctctcctgaggcacttgtgttattgttaatgacaaccacaataatagccccatctaaagtgacaaaaatgattgaaaattcaagcactgaattagcattactctagagtgctaggaatagaagcttcttcctaggggttggctttgggagcaatgagctaagaagaaccatgactatgcagagaaggagctctcttttctctttgggcttggcttttcattaagctaacattgatttgaactctggatttatgtgtttgtcaaaagcttctctgagacatcatctgcgatgccagccccctcaccagtgatgaggctgtcaatgaagacaggtccctttggctgctgggaagctctgtttgcaggactagaaaatcgccactacagttctctctactgaggtttgctctcattctgaacttggctaatgtttggaggggaaataaaagagaagaaaacatgccagtcttcagagcttattgattgctctattttaaaggactcaaggtatgttccttttcttcccacctcctgtaagctttaagcactctagaacatccattaactgacttctcctacatgattcacttgtcagacttcccaagtcctactgccgtgggcacttgaaggtgagcgaggcaggagcctgggtttggatgggttctgggcatcttagtgcttggagcaggagctgctgtttgagctgggtcattatttggtgggccaggattctcattactaccttgtgatatgtttcatactttttaaaaagcttttttactccaagggagactttggctaggatatacagatttttcataaattttcaaagattgcagcccaggatgctgttgctaagagtttatcagtcagcagggaccatactgcagccctgccctgacactgcaacagggatgcgaaagtcgtaaacaacacagctcgacttctgtgcccaaaaaaggctctgaacagaatgaaccttacaaaatccaattactcagtctctggcaggaaaggaaagcctctcaaagttagaataaaatttcctggcagagaaatagaggaaaggctgccaagatgtctgtgagtatcccagcgcatggtgcggtgaggttggcaccacagcaggcgcctgggcttggcttggaggtccggccccgtggcggtcactcgactcctcaaagagggtggctcttccacagagacagcttcctacaactggacccagcacgagaggctccgtgtctacatttgtttttcattaatgatgggatatgtcacagtttctagcaggcaggcccttttagatcacaccagatgatctgcggggctaggttacacacttttcatggaaaattttgggcgcctgtctgatcatgaggttaaccattcattctagctggaaattaatgtcactgtaatattggattcttgtggtcagagcccagagcattttgaagcaccacagttccacttcccagtaattagaaaatgccatcgacccattgtcaggcatcacaaggaggtcaagggctcttgctgatacatgatcctgcatggactgggatggatctctggcgaacggtcatatttacaaatggaaatgactggcaggcttcctctggtgttaagccccccagtgaccagctcttggaaggccatagaccactcatggcatctgcctagctatctattttcatagccatatgtaggattattgtctagtgagacgcatttagcaaatattgtaacgtgttatataaccatggtgacctccacaaactatgtaacctctctgtgtctcagttacaaaagaaacttttcctatgttggctggaagggttaaattaaataatgcatataaatggcttataaaattatatggtcaaaggaattacattctaatttttgaaattttttcaaaggaaattttcagttttaatgcccaatctactgggtgaaacaaaagagattccaggtataccttcccctttcccaaaaaaagataatcaaaagcaaaacatagtagcttatcccttgtcctgatacaagcaagctaataaaatcttgtgtactttagggcaggtagtgccacctcacatacatggtttaactgaagtgtttcactgaagttagctgatcaagagccactttgcacttgaccaatctttaagtgctgctatgcctggaccaaatgtgacttcagccaggagaacccaggccttagaatttaggagccattaggtcaagatgtctccagtggtgggtggggcagcagaagggtgatggttgatggagcaggtgttctgcccacctggtctcttaccactgccttcccggcaggaggcagctgggctatgtgctgagagtcaggcagtttatccagaccacaagaaagggttgtcctgggactcatgccagcaaacaccttccaaaacaaacatagccaggtttgaaaagaggcagcctcggagcctgcctcagggtgtttccatgggcactcaaaagcttggataacttctggttgagggtttcttggaagcagcctgttggtgtggaagcaggtggcctgctgctgtgctagctgtcattggagacagacagcatggcggtgagtgtggccaggtggggaacctggttctgcgcctgtctctgtgaccttggaaagctacacagacctctctacatcttggttacaaaagcaagacttctttcatatgttggttgaaaggttaaattaagtaatgcacacgaagtgcttataaaaactatgtgacatttacagaattctcaatacatgttagctattcttctcattattactggaaaggaaatataaggtatttcactccggaataaatagaataatcgaggcaggcagtgtggggtaatggacttcaggtggaaagaggctgggaagagtgaagatacctgggttctggttgaacaagccagaaaacctcagggtggctgttctgaaaccctaaaactagggccctggtgtttttcccaaagtgctgctggggaaacagctgcaggatgtttctggggcactggtgtgggggaagataccctgtacaaagacatgtgtttgtttaagtgttaagtacagtttaaaagttttatttaatgaaggcttgcattatcagagttgatgaggggggcacggagtggattttcaacctggggctttagagtgcaggccttctggattgatgtgtagtcgattacagatgtttattccttggagtggcatccgtagcctcccctggaaagatcccaaatggatcagagctgagggatttctgtcccaaatgcctggaactgactggcatattggcatatatggtggtatatataagtcaaattttctgcacatttgctggtactgattcttcttcacaagaacaattctctaccttctagctttggtactcacgtagccttcaagacgctctcctgtctaatatttcccacatcctggggtttggattgagaaggcatggctgtggcagccactttgtgtaaagtggcaaatagggcagcttaccaatggtctccatcgtgtctctctcttcaatcaaaagctgagccctgggtatgtcgatgtgcattcgcagggtctgctgttgcttgcttaacgtatctgaagtccgggtattcttactgggaataaaatggggtaatgcattaacaaatccagttcagtgttaacattctaccaacatgcacctgtataccaacttagtttattgtctaaatatacaaataccttgtgaggaggggaacagaaaacgtacatactatgaaaacgtttccttcattcaaatgttatttatttattaatattaaatttcagctggctggagagtttcagaaaatacaaattgtcaatagagattggctctatatctaccaatagaatctttagaaagttctcatttcttgtgtaaatgctaaatgaaacaaatgaaaagcaattaaaaaccaacagcattttcatttgtcagatgtgagatattccagtgatggtgaggaataaagcaccagatattccaaagatggtgagggaaaaagcacgtgcaccagctgtttgtcggatgggagttttactaatggatttgtatttatatctggtgtcattttatttttgttctagaagcaaatcacaaaccttgttagcttccctgacgttagttttcctaactgatagtacattttagaatggaaaaaaagcaattactatcataatttaatctcaaaatttgtgtatcagaagattactcttagagtgagctgttctctaaaagtaaatgaaaataagtagtaaaactgcatggtagaatcggattcagttatagcctgcagttaaaaaaaaaactccacgttgcacaaaaatctaaaaaagtcaataaagactttaattagcaatccacattagaagggtggttgttcagtctttacagaataataagactttactagatgttcaaatagtatttactgaagcatcctctaagaagcagcagtcacttggataatccaatcaatggcataatctatggcatccatcaatccagctcaattgttgttaacactggttttgagaaagatttctggagcctagttaactcaataatggtttacctctgtgttacttttagtggagaccaaaataggaatactcaatgctacattttaaatgctttcccctctaaccgagccatttaccccgagtcccagggctgtgcctccaccgatccttccttgttaatgaggactcatccactcttaaaccaagtggtggacagaactttaattatcccaaagtgaaggtcactcaagtacccccttagatgtttgcctgatgagatccatgtatactcctcgtttgagtaaaagcaaattatcccatgaaaaagacaacttctgaaaggtgcaacattcctacttaggacttgatcttgaaccagattgcttgctctgcagataaggaactgggctatgtacctacatcatgctaattatgcagagcccaaattcaaacgttttgtcctgacttttcacatggtctccaagctctttcaaattactgacttaactaacttgtcattcgttgattttgttaaaaagagagtaatgaaaaaattcaaataatcaaataaaaggaggagcattttggttacttggggggctgcatttacggcatgcttagacaagctatatttccacaaaaacatatggggaactactcctctgtgaatatcccaaagatctgtttagaaacctcactagggacttgagcttgtccttgcaccaaaaatagaagtgtgagctagttccttctgctcttcatgaatagttatgaggcagtcagcggctgctctattaaatagcgatgaacaccaagtgcaggctatacttaaacaacaataaggggtctgctaccagattgccacaggaagcaggctaaataatggctgtgaaccactgcgactggctggcaccaagatttagaacttgattcaactctgcgaaccaggacaaccaaggctggaggtaaattcttcctcctcagaagactataagaaaacggcccaacaagccttgagattcagaagctaattgtttttagagacagggtcttgctctgtcgcccaggctggagtgcagtgatgcaatcacagttcactgcagtcttttttttttttttttttttgagatggactcttgctctgttgcccaggctggagtgcagtggcgcgatctcagctcactgcaagctccgcctcccaggttcacaccattctccttcctcagcctcccgagtagctgggactacaggtgcccaccaccatgtctggcttttttgtatttttagtagagaccgggtttcgccctgttagccagaatggtctcaatctcctgacctcgtgatccacccgcctcagcctcccaaagtgctgggattacaggtgtgagccactgcgcctggccggactcacagttcttctttctctttgcacttggctgttcccgttgtttagaacacacttcccctgctacccccaaaacccacatactggctcccttgttgcaaggctggactcagatgccatcatctttccagtggagccaggctggccctgcgatggggacgtcttctgtgtcctgtccccattctctgtttaattttgtctgcttggcacttattactctctagcatatacttagttgatttatcttatccattatctgcctctctcactggaaaatatgctccaccagggttttcttcacctgctctgtttcctgtgtctccctagaacttagaacagtatatggccaaagtaggtgctcaataaatatctgtgaagtaaatcctcacattgatttattttgagggcacaacgtgagctgagtgagatgtccccaagactttgttttgaggcaataatatccttctcattctaaaaggtcactggattccaactaagttatttcattacttaatatttgctgtcacttttgacaatctattgttacatttatatttatcactctgtgttctgttaacctcaaaaatgataacaattggtcattagaatggcagcaaaccttaaaaaagtgatttgaacaaacctcatttgcaacctggaaaaacagtccaaatgttttcactgtggaagcaaaaattgcatcttttttgcatggcataggatcatgctaaacatattagttattattgagctataatcttcaaccatccatttatttgccatctggttgtttgaataaaatgagaagaagaggagagcagagacggtttcatagggcagagaatttcccagcttagccaatcaattatttgcagccactgccactcttcaaagtcttaatagtccatcatcctcccaaatatgacacagaacattccttaaatgtacaatgactattggactattaggagcatagctcattataacactagggtagagattttttattatgtgcacaaaaatatgaacatcaaaaaagctgaactaatttgaacctttttctgcttacacccaactcactcgctaatgctgattcctggaccttaaacattatatgttagctctctacagtatacagttatctctttggagcaaacacctcttagaaggctgttttttaaaaataaaaatcttacataaaaatataaaaggacaatctttctgtctgggtgtgagggatgcagtctctcttctctggggtgatgtgcatgggtgaaacaggtggatatctaggagcatgaagcccagcaatgggtgatgctgccaggccaggaatccctggggacctagactgagtgggtatgttctgctgtccaatctgccttcctggcctggccctcagctaatctccctgaaatacgcagatacttcttggtagaaaatggttgaaaaataaatgttacatccatttagaacacagaatgtggagtgataaagctagaaacaatgttgaattttttattttatttttattttttaggtaaggaaaacaaagcggtaaaatgacctactaagatctgaaaaccagcttatggccacatggggcctagagcacagacttgtggttcgtattctcactgtaccaggctgccagttcctttgacttctagagaaaacagcaacacagaccaggggtagctgttcagtatctttctctctgccagtggacatgatttgtctggaccccctgggccatgtccaaatatggttgattctaaattgaccagttaggtaatgaggtttttgtttgcttggcccattcacctgccgaacttagattgaaccaacctttcatgggtaaaagctttgcttttacttctaaattaatcccatacaaatccacctattggaggagcttgaaaattctcttccttttcaatcactttgaccatttgaaggaaaaccactgtaactatcataagtggttgtgattactggctttactcttcctaattcatgctggtaactggcaataggaagaccataattaattcctcctcttatcaacagatggtcttgcaaccacagcaactgccctattcatagaggatgcttgctaatgtctttctcagaggctagggagaaggagtaggaatgtactctagaatatgaggagaagagaaaaagcaaatcatcctaattgagcaaatgttgaacatgtcagaaaatatagcccgcagtttcacagcctctggacaaaggcatgatttacagtttgggagtagataggggagggggccagggtaggttgtgcagagcacagttgaggggaggagaagctctctggagggctgaaggagccctgctcagtgtacggactggtgaagcaggcccggggtggggtaggggtgggggctgcggtggtgagcaaactcacgccattctaaagggctactgtgcctacctccaggcaccattatcacctccgcggtgctagtatggccagggcattttcaagagaaatcagaaagccaaattttatgtgaaatctcctcattttaaatgtcatcaactaattcatatttttaaagtctacctttgacaatttcttttattaggtagatcagttattacaagtcatgtgactctgacttctttgttttccagcttctttgtgttaagcagatctttgttttatcagatctgcttaacacaagtgcatgtgtgtttggatgtgttccctgtgacccataaatgtcacataaacaaaaagcacgggctgaaggcatctcatgcaatttctgtaatcttctcctggaaatgtgatgaagtaccccttatgaaggagatactgtacagggaatttgcatctttgcttttcctctgagctccagatttctgctaccagttgtctatctgacatttcctctggatgccttaaaaataatcccaaattcaacatgacccaaataggtcttttcattcccatcaatacctcctcccaacctaccttccaaaaaaatcaaaagtccatagcctgcctctatcttcctaatcttggcagatggcaccaacattcatcagatcagtcacaacaaatgtattttagagttatccttccgtggtggctcatgcctgtaatcccagcattttgggaggctgaggcgggagaattgcctcaggtcaggagttcgagaccagcctggccaacatggtgaaactctgtctctactaaaaatacaaaaatcagccaggcatggtggcgggcgcctgtaatcgtggctcctcgggaggctgaggcaggaaaatcgcttgaacctctgaggcggaggttgcagtgagccaagaccgcaccattgcactccagcctgggcgacaagagcaaaactctgtcccaaaaaaaaaaaaaaaagaaaaaggaaaagacttatccttcatatcattgttttacctacgattcacattgttttgaaatacggtatggccaaacaaaatgtctgtaggatggaatctgtgtgccaatggcattctactactgccttcggtcttcaaagatattagtgatatggaacatgggaagtttttaaataacaaagagtactaattttatatgtatagatggaggaggaagtcacaggcaaatgtgttggtgatgggagtgggaagaggtcctagatccaccctctctctcccacgtaaatcatcctaaactggcaatgttgagttcactatcggagtccttgacattttccctacttatttcctagactctgattttcctttttcacttttcatgtaatcattgcaatatgaaaggcctaaaatgcaaatatcagggtgaggtaacacatcaggcaattaatccatacgtgtaaatgcttcatatcagagtgttctagtatttacagagtaaaaaggttggacagcacaagaaaactgaacatttgaagagggggactgggtggaaaatagagtttggggacgtgaaagtaacacacttgtcacagctttgccaatcacaagcctgtggacgtgtgaaaggaaagctgtgaaggatgcatttctgtcttccacagttgtgaacattctcgtactcattcaataaccactcttcattcatcccctccacggttatgaatggggcaactactgtgctggctactcctaacacgaggatgaactatgaaggctgtgacttccaggaccagaatagacagtgaacagacagtggtaagaggagctgaagggtgccctggtggagggtgctgatggagacacagagcctttgaagagcatggggcatagcacattccttttgtgcttttcttttaacttggattattctgttagaaagaaggcttgacctcaccagtagtaaatttagatgaaggcaaaactaaagctacttcctctttacgtgcttctgttcccaggctaatgggaagccttctattggttgtgtccagccaacaagacaactacctgtggcatgtctacaaatacatcattttcatctacaccttcagctaggcattacatggatattttggaatgtataggaaattacagttttttctaaaaagaaaagacattatcaatttcagactgccattattaaaaaaatagaaatcatcaaggcaagttggaaattgttctttcaaacatgatatctggggtgctaggtcttgttcttacctcatgagcatttcagctaaactctttgcatctggggaaagaaagttaacattagtacatggtaaataactcattaacattcacttaggcatttatgacaaatactctacagtcagatcagaacagtcattttgaaacacaatcatatacccagctcactactaatgacctagagtttcatggagtccttatttcttctaaatgggacttttaaaatgtattttattaattacaaaaatatcaacataactatcctatgattataacattctcagacatctactaaatgttttattccaacctacagtcacttctaggaaatccaattttattttcagtagtcagaaaattaacattttgagggtatatcatttacgttgaacaaacccatgctttttgttatcaaaatatcagaagtaagtggcattattacagagctctgagttccttgggttgaccaaagaatcgtataaatgaaatataaatgttcctggaaacttagatgtttattttgaattcagaaattaaaaaaactttattttttttttctctgagcacattgtttaccaagaccgggttaccactcttgacagaaggaatcctgactaaaagtgtaggaaaaaaaaaatccctttttttggtggtgttattttgaaattcccgtttcctttaaaatataatttattctttttacacatttggtcctggcaaaaatgaatgtttccttacttagagcacaaaaaccttctttttgtttttatttcattgctctctaaaaagtcttgatgctaagtatactgttcaatgaacagaactttccggaaatggactcagctgacagtgtgaccagctctgcagtgaaagtatacgtatgtgggagcatttccatctcatgcctttgggggctgacaattaaacgtagtcagtttctgcacagtgggcagcatgctatttctgaaagacgtggacagtcacagaatgaccacgtagaggctgtccttgccatgagccaagcttagttcgttaagttggccagtcccaatggtaaccccaagatggggcctggttttgtgcacagatgggttcagcctgggcaatgaaacagggcccatatactccacccacacagcaaagaaaagaaatcaaaataggattggatttcccagttcatgtctttatatttatctgcaaagacacagtaaatataatgaatttcctctttccctgaatgatttaacacttacaaagtatatatatatatatatgtgcttatatatacttcatgtatgtatatatatatacatacacacacacacatatatatacacatacatataatgccagaagcctggacttaattagctccaatgaactaccaagcagtggctggtacaatactctaaaaagggggaaacaaattcaaggagtaaacatcccacttcagttcacacttgaaagagttctcagcctcaattgtcttctgatcaactgctttcctcattctgcccgccacaataatctctccttttcctattctcggtcagtcatcacagctctctcctatgagctgttcatggcaatgtactaaggaattgcggagtccagcagggagaaaagagctccccacaatgactgccatgccgacagcagacctctcttggctgccacgtgcaggcatcctccccaaggctaaggtctttcacaggtctagatgccaagggttgaccgtttgggtcaacccttccctaaacctaacactgaccccaccttaaaggagcatgggacgtggggagctttgccatgaatgggcagtgtgctccatgcagagaattcacatgcatcggaattatgagcccatttgagaagtaaagtctaggtcaatttgactggacagagaagttgccaggatggtggtctggtgcacagtctagacattaaagagctaaggagatgtgactttgtattactgacctgaaagcttctacctgggccaaagggagagaggaaaaaggagggcagaggtgggtggtggatgggtgtgggtgctgtgaactagcatccaccaggcaatccagaatgctctgaatgtggaggtgggggcctgggacttgttgaaagcttcttagtccttagtccaagtgagaggctctgggcattagagaagagagccagggttatgtgggtaacattataatgtgaagatagaggaaatctgtacgaatcagagtcctaccaggtgtacagtgggacaaggaggagttgcagggagtccaggaaaagggcaagatttgggatatgcagagctggatgtagtaacatgagtgacaggaatggactagaacaacatggaagcagcaatcttgggagagacttgtctagtttcaatatcgggggacattaggtgaggctgttcagaggcaaatttggaatcaaatttggaaagatgccagggctgagatgagggtctgggtgtttttcatatccccatagagagagtgcaaaaagaagatggcaaaatctcatctgggacacacttttgttgagggtgagaagagagtctgagacaagccaagaaaaaaatttaaagtcccggaatcacagaatcttaagagcaataaagacttttcagattggccacctaatgaatgttggaatccctttcacaatgtcttacacagacgtacacatattctctgtctgcatgaatccagagctggggccactgccactccacggttggggtcggtgctcctgctgcacacctagtgtccttcctctcctcccagtactctcctgccttccaggtctgcaggtctctcccagccagcatgtccccaggggaacctttgttttttctcttctcagtcctaatctcacttattagtcagcatccttactgctggtgtgcccaacactgatacccacactgcaggaagggtgaagactggaatccatcttactgagtgatacctgtgctttgaaaccttcaaagggacctcactgcaacagccctcattagcacagagaacccaccttccgtgctggtccaagctgtcatccggctccgctgccgctcacttgtaacctccaacctctctctgagtttcctgcacttgccactttctgcagagagcccaagactttgctagtgcaaagccctccatcgtccccaccgccccatgcagacgcaacttgctccgtgtaccctcccatgcccagtaggcaggggtgaagcttcggttccctccgcttccctggacctctgccttatatctcagacagcccttcccagctcatactgtgcccacctgttttcgggttgtctttctcttggcccttttgggcacagtcctgtccctgatccatagtgaagctgcacaaagatttcctgaggacacatttaattgtgagagacatcttccttttcttgtgcagaaattccttgatgtaattttaacctgaagtcatttgccagctgttcagatatttccatgtagctgcatttcccttgcttggcctcagctttctcttttctgggttacattctctaattttctcagccactcctcatacggaatgatttctaggtaattccctacttgggaatctcttctttgaaaggtttgtgatttttttatttctctataaaatgaggctgagaaagacgctggtaattcttgatcttctagcacactagggagagcacaatgctcattatacgtgttgcaaatgaatttttttttacaacttctatagaagacttcacaattattcctattaaactgtatcttcttgcttccagcctttcaaaatctcttaaaatgtggatttgtccctctaatacattagcttccccaccaggatgtatgtggcctccaagattggattagcctgcccatgctttcagctacatcctggtgtacccttattaatcagccctgtcaaaatgcaaatggagtttgtctgggcccctggtggtcccttcccttccctgattgctcacaaaacatcctttctataacctcaactaacttatttcagtctataatgtccagaattaatctattgttgttgaaaatgggtccagggtctagatgctctttgacttacgattacctcctgatgaacccatcatcaattgaaaatataattaagtcaaaaatgcatttaatatgcctgacctaccaaacatcagggcttagcctagcctatcttcaacgtgctcagaacatttaccctaccctacagttgggcaaaactatctaacacagagcttattttataataaggtgttgagtatctcatgtaaaaataatggatcacatatcactaacccagacaaagatcaaaattcaaaatacagtttctactgaatgcatatcatttttgcaccattgcaaagtcaaaaactcctaagttgaaccatagtaagtcagggaccatctgcataatcattttctaacacctctaatttacatttgattgttcaaaggttatccagaaagatcttggggttatgtctggaaaaattttgttcagaaccctaaaatgttatccttcagaatcatgggactggaaccccatgacagcttccctaattttttaagtggtggagatctttcctttcagtgaaacagcacagcatttattctgtctgcattaggctgcttacgctttggaacttgtgtaatagttctttgtaaacattgtctgcaaaaagcaacatctccacctccacataatggctaatacagagtatgttttgaaaaaaaataaatccttttaaactatcagggtgctgattattttcataagcatcctgagtttctcccttcccctcccctcccctcccctcattccctccctcccctcattccctccctccctccctccctccctccctcccttccttccttccttctttttataattcctggtccacgttttctgattcaaatagcatttctcctggtacacatcaagcaaagcagatgctgagcagctctcctgtctacctgccatctgttaatatgagaacattgttcacagccttgttcttcttgcccaaacacagctaaacagcccttgcattgcctgtcacattttttcccacacatttcagatcagcctgagattcagacttcgcgacatcttttctaaagccgcttgctactcccacacttccatccttggctctgggctcctcccttatctgttgggctgggaaatgatggagaaatgataccaggataatctagtgatattaaaatgtggaaggaaggaatttcaaaagacaacatttgctaacactctgaatgctgcaaagagggctaaaaaatgatggctgaaaggataatttggagatcagagaataactggtcatctgtcttcaggagaacagttacatttgggtggcgagtggaaggggactgtgggaatttgggagtaattgagaggtagtgtagctgaggacagaatactctcaagtattcagtggagaaaagaatcagagagacagtaggatgaagatatgcaagctagaaggaatatgtatatgtgcctctctctgtatataatatatacatatttaaaatataattaggggaaggctgaagggtagtgaatatcgaaatacaaaatcaatagaccaagtatttttgatgggcaaacataaaattatatagtagctattgatactgtgttaatacatcttctaattccaggtataattgataaacctttagagcttacttaatattgatgagacaacctgtttcttacttgaatattcaaaatcctgcagaagtttcatggcaagaggagtagggtagggagattgatctgaactctcttctagctctgcctggactcatatgtgattctggataattctatagctggccttcagttttcacgtcagaaaatggggtatgatggctggacgcagtggctcatgcctataatcccagcactttgggaggctgaggcaggcggatcacctgaggttgtgagttcgagaccagcctgaccaacttggagaaaccccgtctctactaaaaatacaaaattagccgggcatggtggtgcatgcccacaatcccagctacttgggaggctgaggcaggagagtcgcttgaacccaggaggtggaggttgtggtgagctgagatcataccattgcactccagcctgggcaaaaagagcaaaactctgtctcagaaaaaaaaaaaaaagaaaaagaaaagaaagaaaattggggcatcataatgggcagttcatactcaaccattttgcatggctattgagagactaaggcaggatggtgtatagtgaagtactatggagaagaaagaggagcgaaacaatgggaagcattagtagcctgtggattagtacatggttagatcgagttttgggaaatggcacctctggttggatgaggaggctcccagcttggtcttgcccagttcctgtgttctgtttatagaccacagcttgcatcctggggttgtgcctggcatgaaggtgcacatcagcaaggcagagcatgacacagcatggcgtgggagagtgcccaccatggccccaggcactgcagctgtgcaaagcttgagaggctgaactgcctcacattttgcacactcaaatgcttctttaaaaaagagaaatcttgtttatagccacatggctacattttcatatctgaagttctagttacgtaaaatggaagacgcttaggttaatacttctactgggcagtcacttgcagatatccacaaaaaaactttctgagggtggcagattttgaccttatattaccatccatcaaaaggttttatttgcagcctctccctcaacagtccctgcctttctgtggaattgaaatagtctcataaagtagctatttttgcaagggctataaacctgcatttatgtttttataagatcccaaataggacttccaatcatcacaatgctcagatgaaagctaatttgaaaactgtggcagacatatattaaaaaaagaaggccatatatactggtaatctgaaaaaactgcatgcacagacacagacaaaataggacacccaggcaaggcagagctccagggcccggctgagacccacaatcccctcctgactacccactccctggctcccctccactggtagccctcgactccccctcacccccatgctcttttgcttcccgctgtcagatgcagagagccttttctattcagtttgccataacaagtttgatgttttaagagaataatttcattaagaaaccaagacagaaagaaagagagaggaagagaaagagagagggagagagagaaaaaaggagagagaaggggaaaggaaggaaggaaggtagggaaggagggagggagggagggagtgaaggagggagggagggagggaaggagagagaaggaaggaaggatagaaggaaagaaggaaggtagggaaggagggagggagggaaggagggagggaaggagagaaaagcaaggaaggaaggaaaagaaaagaaaagaaaagaaaaagaaagagaaagaaagacaaagagaaagaaagaaagaaaacacaaagcacagaactaaagagtttcagagtacaggcttctaatgccatcttagccacacttggtaacgaaagctctagggtgcatgtgtgctactcatgcattaacaatgtgggcttcccacattcagggtggctttatgcattagtgctggggcatctattgaaactttgagtctatctcaagtctgagtgtcactgggttcctggatgcacattcctgctttaggttagtaaagttcaagttaccttttggttttccaaatgaggggagctttgggctcatttgcagagcagataaatgtcctgttagtactcagaaaataacaatgatttctcataacctaccccttaatctgcctgcatagcaccatgaacccagatcctctctgggaacagtctcttccggaattgatcagttttgtaacaatccatttcaaagcatgtttaaaataataaacacatttccattcaagagaagcaagacactctgccacaaaagcatggtcaaatgtgacatcactcactgatttttatctttagcttatttgaagtcctgcaggttgacccacactaactggtgccaacagaagcttgtgccttcttgcgtaaatgcgtaccaaaggaggaggcttttagaaatattggagttgattacttgacacgggatcacattttataaggttagggctgctgggatctcaggcccaaccagtgactcactctataaccttgcacttcaaaggatctagaagttcaagaaaaaccagggcatcattaaaagcaaaatgcggctcctgaactcctggataaggttatagatttaaaaaaaaatgtgggcacttgcaggcaatttagagtttaggaggtcgccatgctctaaaattagtaaagtactcaggaagagagaatataggttgacgacactgctagagtcccattttctttctttctttctaaaattttacataaaataacattatattatattcatctaactaggttacttgtctatacagtaaaacatactcagcttataaacatttttgctgtttctagcaattgaaaaatgtgatcaatttcaaccatataaaattgatcccacctaatcactctaaaaacatccactggggatccctataatatttttctataattcaaatctccttatttccatttttgatcctgatagatggttgctcacgcaacactgacatgttactagaaatgttgtccttaattttgacaatcaaaatattctgtctgtagagtctgtaaatatatttgaacttattctcccagaggcacagagtctgtaccttatgtgggttcgcttgttattgggtgattcgactaatgcactccggatatttaatagacaggcacctattcctttaaactctgcagctgcaatttccctccatgagtgagttgaaaatactttgtatcattaatgaacatttcagggccctgcagggctaagaaacaaacgtctttctggggcaatgcctgacctttcatcgattcccctttaccaccctcacctctggcgctgtccttttatggcagtgctttgcacagttacggagatgagtctgccccttgcaagccttgacccactgccactacaatgtcacctttatagttctgagtcttagaaatctcttctctctctaggacctggctaaactcttgtgatcaaatagaaatggtcaaccagcaaatgttaccactagtttaaaaaaaggttccatcttgcacctggtagataatctacagtggtttgtcaaactgaatttattgcagtgtgtctacattaaaacttgccattcagaagtggtgtgaaattgggtacccaatccttggcatcctgaccgccctcctgtcagattcttttttttttttttgagacagagtctcgctctgtcacccaggctggagtgcagtggcgggatctcggctcactgcaagctccgcctcccaggttcaagcgattctcctgcctcagcctcccaagtagttgggactacaggcgcccgccaccacccccggctaattttttttgtatttttagtagagacggggtttcaccatgttagccaggatggtctcgatctcctgacctcgtgatccgcccaccttggcctcccaaagtgctaggattacaggtgtgagccaccgcacccggcctctcctgtcagattcttgatttgagagaaccctttattagccatgtacaaaatgccgaactgcagatacctttgtgccatggcaagctacttttctgaaatcctttgctccttaacatctcttagtaatactccctctttccctcagcacttactttcttcctactgaaacctttgtgttggatttaccttttccccagaacatagaaatcaaaactatttccggagaatgaaaggccatgttctctgaggtgatagactgctgtctttaccaaaaccaactgcaaaacactagtgtctggaagcagggaggccaacaataaaaatgccagccccaggatgttttctggagatagcccttgtacagcaacaattaaattacaaggaactactaagaatacaaatacagggtgcatgggtcatcatttcaacccaaaggcctcactcagtaagagcccacagcacctttaactggaggtgctctcagcgagaggaaatgcacagctggggtgctcaagttcgaaggtgagtaggaaaaataaaatagtagctgagaaggatggagagcaataggagtcagggaaaagaagaaaaagtgaatttggcgagggtgtagaccgatgagaagcattacctagatgcttaactcttgtgattaaatcaaaatcattaataagaaatatttactattggtttttagaaacatcatacagacaatgtgcagccttctaaatgcaagtagttagacatagttgtctaatggtaacaaggaaagacacccttggtatctcataataattctcctaaagtccaggccactgtgaacaagggttatgaaaacatcctttttgtgttttagtgatgaactgaatggaattcaacatggtccacattatatggaacttctcaccataatgggctgtattatacgcttgtagttctgttttacttagcactgaagtagcctcccttttcctctccacttgggattaatccgtccttctttttcactgatgcggtctttctttgaagccctatttctgtattcatgacatgttttgtctttcactggtagctgcttatgggcctacctcctaccttaaacctagagttcagaaagctctttcttctcatctttgtgtattaagcacctagcattcactcaagtaatgtctgcaaaattaaaagataattggttcgcacgattgcgaaagaacatttcaaggagactgatggctgacctgaattattgggctgcaggagatttacatggacagattcttaattgtacagatgaagtacaatgtacttcagaattgtaatttgttggcagagcaaaagcaagttgatagtgaaatgtaccagaattccataaaaagcagtgctttggtgctttggataagtgaagacaggtgaaaatattaccatgttctctgctctaagtggattatggtcaaattaagtatttacagaagaggtcaacgttttctaaatgtatcagtaaagtttgggatatgttttgaggagagagtgcttccagatttgtactttgaacataactttgaaacacacataggatgctgcatagcagtatcccacactgcactgatattaaaatgaaaatcccttgtaatacacgttaccgaaaaagtggcttagttaaacaccctcactggtaaagggcaaaggacctgggaacacgtctgcacagtttcatatttgaaataactccctgtcctcacattgcagagcaagggcaagtaagggctcttggccagaagctgagaacagcctcatcacagaacgacacggggctggacattataatcatggtgtctgttcacaatggagctcatctggcctggcttctccagccttcattatgtttttgctacattagagtgaaactcttacactgggcttcagctcccgtttctaatttgggatggcatgtgtcctctgcctcacaatgcttcaccagtatcctaagccctcaatttccacttccagtcagtcaagtaattctcattcccagagcaaatctgatagatcttttcatagaaagccacaattggtggctttgctggacccactgaaaatttaagagactagagttaaaaaattaattttccttgcataccaacagctaggatttaggggacaggttggctttcacctgatttctgaccgagataggaacattcttattgctcttccctgaggctctgcagtctcgctgaaggaatgtcagagaaccaggcagtggagggacctgggttaaagagggaagagtcactcccttttgaggtttgttctccagctggcatctctcccattggctgcagagcagcaggggacacgcgtaggtggacagctgggcctggacctacctcgcagcctctttagcctctgctcccgccgcctcctccgcacaaccagcaggagcacaaacagcagcaagacccccaccaggatacaggagatggtcaccagcatcttgagcccctcgttggtcgtcagcccttcttcgttttggacaactgacttaatgagtggaggaattgtacctgaaagcagggccacggtgttagatggctattaatgaagacggcatggcggagcttttagggatgacaggttataaaaatcgcgctgtgtgatccaagggtgttggaggtgatgagaaatgaaaagaactctgtctctaggccctggctaactttttttcttatttatttccctccctctgcctgaacttccaacttattctatagtgcacgtttgaaaaggacttcattttgcaatgcactacagtgtgcaggcacttgaaagcatgaggcccaggcttggtgctgacaaaagccacatgcatctacccagaattaagtgttcccttgactgtcacccacagtacaattgatagagactattcgaaaaaattgcacatcaaagaatgaacaaaaggttgggcaaatggacagaagcgcgtgtgcagggagagggtcctagatacactggcataaagaaactcaaatcccttgtgattaggtaatttgctggcttttatcgcaggtgtaagaccaaatctacttcaacagctgtggtttgagggtacaagagctacagacagcttttcaaaggggacccaactaggtttctaaaggagcctacttttgatcaggcatggttaaatagtgctacaaaatctagattatttcgagtaataaggaaacactgaaggaagatgaactctgagctatcttaagctgccttctatccagatgctcagtaccgtgggtgcagagatctaaacacaggcatccactttttatgaggtatatattttgctaccctccattatataagatgctccacgccactgcactttccatgtacaacaagggccagaaagtcagcacttcaggaaaagagaatgcaaaaataatataatttctccctcagcaaaacggtctttatcctgcatttagtaagcagagcagggataatggaatcctcgttcctctgtgatctctgctaaagctgagaagagtgttctcccaactttaaagtgtttttgtggaagcccaagtctccaaatgcttagaaattcaggaaagaggcacttacaggatgcccatgaagaggggtctgcaaaaccaagacaacactaggtcaagcagaaacattcggctaaggaaatggcagaagaaagagtgagatcattaaatggaggactctgaaacctgagtggtatgaatgtaggctgccaatcttggctttctcaagataacaaagttcttcaggcagatgtgacaatagaggctatccattcatgagactggtccaaagaaatctgtaatctctctcaaggaaaatataaatatgcagccatatttcttagtgtaataaagtgatttcatatttccaaaacgtaaaggtagcttgcagcatttttcaaaatttgggatcttggataaagtgagaaaattatatcttttcttagaagacaaacatttaaaatccgcagaacactttgtgaattagaatcacagtttcaaattctacacatgagtagtttctaattaaatcattagctgtgagcatatcatcagtgtgcacatttaagctgggtgcccaggcatctgcacatattatagagaagctgggaaccagagtgtgaatattgcaagataatgatctaaagtaaaaaagatacttactactcaaatgtgtgctggttaacagaggattttggtgcacccttaaatgctaagtaaagtgtctggtaagtgtcaaagttctttattttgtaagatcaaataattcaaccatattacagggagaggccagcttggaagtgctcctctgcctctgggtgatgctttgtgatggggacacctttgaatgaagtcactgaagagtgagggctataaaattagaaagaggcagcccatgaaaagcatcagcccttgaagagaaaagttgtcgtctgggagggcataggctattctggggccataggacagagcccgtgcagaggccagggaccccggctagcgtaaccaacactagaagagctttctacaagctcaaggtcttcctacagccctgagacccaggccagaagtgccaggaagaccctggactctggcagagaaggatgttgtggaaaaatgaccttggacaggagatttggggtaggtctgctctgtgtgccaaagcaagaagagccagccctgggccatccggacattataggagaaattggtccgatgaaaatcccaggcaatgtcacctcattagctcctggtggtcatttctgtgggtccttaggttcacagccactcttcttaggatggcataaactgtgctccaaggagctacctgctggagctttaataaagcggcctcccaaatgcacaaagtaaagaaagaatcactctcctagagagcaatgctgatgcttttcatgggctgcctctgtctaattttacagccctcagttatgagtgacttcattgaaaggcatcccctcacaaagcatcacccacaggtagaggagcacttccaacgtggtcttggcttggctgtcaataaagggtttgggtgtttcttggttaactcattcaacactgtggtctagcctgaccaacaggcagtgaatagaaggctctgaggagagttgcactggagttccaactcatcctgatgcattgctgccgtttttaccttgcaattagagcacctaactcaatccttgctgttcccctagtgagaaatgagcatcagcccgctgctgctgggactttctaaagttcccctactaagttgcagtcgaggactcgctcctttcagcttcactgggcttagcatttgttcagttagcaataaatggcccttgataccagaaaaaatgagtgagattttaaaccatttatttttggttaactaatgtcaagagacacctcacctagtttttggaaagtaaatgcaagtggcaagtgtgtgtgagtttgtgtgtgtgcacgtgttcatggattcctattattatcctatttccatcagtggccctgctcctgcccagagactaacataagctcctttaccatggaaaattgtttttgcacatgcagtttagggtgtaatgagtgcaaaaaagaaagttgttatgtggattgggatgaggtggggaaaggggtgggagacaacaaaagcaatgttagctcatagacatcaacacaagcacagaaccacagggtcaagagtccttcagccctaagagaaatcactcctgccccatgactccccagtgagactccctatggccctgagtctcttatttctggacacacagtgatggtcatctggatataacgaactagggagccccagacagagtccattgaatcccgaaagcctaatgggctccgtgggcactggtcaaactatggcaaagatgatgttcgatgggaaaggggcagggcccacgtgcacatcccccaagacacaagcaggagagccacaaagccagccagcttactgccatcgtagttcagcgtagcgaagttggcctgcttctccgcgcagcccgcactgttgcacacccgcatctgcagctcataccaggtggcttcctgcaggtcatacaggatgtaggacttggagagagaggtcctctgagctgtggtccaaactgtggtcccaaagggcctgtactctagtgtgaaggaggtgatggggcagccgccatcattccagccaatgaggttcagcctcacgcgtgtggtgttgatgctggcaaacagctcctgctcctttgagaactggggctctgggggagaaggcacatggaggtcagctcacaggacacatggggaggccatcagcatcttcacgcatttccctcggactgcttcctccagcgaggccaggagctcagtccaagtctggctcacaggccactggcaacttgtcccctgttaatagagactttatggaccaacaggctttctccaactgtaatgacctgggtgtgtgacagaaaattgcatgggtggaggttattttggggtatcttagagttccctaaagaacaataggatgttcacatatgggtttccttctgtggtttgcggggcagtgtgctgggcactttttccatcctcatgtgatgaacctgattcaagagaagacagagttggatttgggaagcaccaacagattttcctccacaactaaacacttggtcttggtgcccagggacctaaaggatatatttctgcataaatcaatccccgatcatttgacctcttaccacttgttacccaaaactgtggcaccaggcacaaataatacccttgctatctcattactcgctctcctgccatctgaccccaccccacctggtaggactcctatgggagggaagcctgcaaagacatctcctcaccttcttcctatgcccacatagagctgcatcatccctccttccttctggagttcctgggacaaaacctctttctctgaatatgatttctttgggattcatctccttgaaagtccacattttagattaaaaaaaaaacaaacgcaatttaccccatcattttccctctgaaaagcggtggctatgtggcaatgtggaaatgataggaaggtgggagcaagggtggctaagggagaagggcgcctccaaacggctgagagggcaagcgccacgcttcatggctgcccagccttggcacctcacattcacaccaacgcccttgattttcaaactgacattcttctttttaactgcaaatgaaacaataaaagagaggaccagaacactctggaaggtccagctgtccctctcattatgccgtggcactgctgaagccatgtgaggaatgacaaagttcaaacacataaacgtaaaacatgatggatcttttatgattccaatctcctcttctggccgggaaaagaaaggatattaagaagcgatgagaaggcatacctaccttttcctaaggtctttgcttctatgatttcacttatgcgccctgggcccactccattttgggctgtcagtgtgaacttataccaagtcccacatttgagattttccaagcgataggaacgttcgctggggctgattggaaaactcccccactgctcactattgtcctcggagtactgcagtatgtatcctgcagagaatgagaaagattcacatgagcactgtgtttgctttctatgggaagtggactgatgcttgcattttgtgtgggtaatagaacgagcattctcagaactgaagaatcttcagaaggaacattttcgctctttctgattccaggaaatgtaacccagcctgggagaagcaccatgatgtattgattagtgagtcatttgggccacaccagacattatcactgtgaagtattgctgttttctgctcattctcttctaaaagccatattgagcagcagggaatacttaagttgccaaatatctgtccctcagatcatacatgcctgaatccttgagtgaagacataggctgaagctgttatttttgcaagacactcgaatctctgggaaagggatacattatcaatgggagtagagatttcttcaactgcctcactcctcatgtactcctggtctcacagttcacagacactaggagaaacagctccaagtcttgcagccatcccactattctgacagtaacctggcttctctttggtttgaaaaattcctccaacaattcattcccccacatgagcactacctctacttttacaactagtaaggatgactgtccactctagagcactcactccatgccaagccctgtcctaagccctttgcttacagtatttctgcaaccctatggaacagtgacgactctcccacagaacacgtgggacactgaagtccagagcagttaagcggtgagtcccaagtgctgaaaggaggatgcagatcctgcagtcagcctgaagcccatgttcttcacccctgtgaatgctgaaatattcttcctgttaactccttcagccctgttatctgcagccatgttccttctccaccctggctagctggcctggaacatggtgtgtttgcaacaacgggttggtaccttctattcctgtcctgtggagctccattttaataaaaataaagcattttttttccctgcacactacagtgtctcctaaacccaaatgggcaggtttgctgatttccacaccccttacatggcgatcactcatctctgatgcctccttctgaggtcattgtcagtatctcccctactcctttcagccttccctcaccactggccttctgtggccatagggtccctcctccttcctgagcctttgtgttcctcatctgacctccataaagctccttcagtacctgacaggtgatacctgtgcacctgctcccagccacatcccagcctgtattccagccgccctacacattgtagggactctgctttcctcccactttccaccctcgaagccacctcaaaaaactcctctaatccttggtgataggcctgtatagttccctgtcccctgctatcatcctcagtgccatcagtgtccatcagtgtgggcacacaacttacgacacctcctgatgatggcaatggctttggccactactgtgtttcaggaatgctgggttacctttgtcttggaaactctccctcactaaaactggcttcatctggaagaccttgtgctctgacacacccttcttgttctacctctcccatgctctcacacttgtagaatccaagcctcatttcatttgagcctaaaacctagggtccctcgagcccatccctaggtgccccctatttttttcctataagaaggttctctagtcagcctggaacctttggtaggccatttcaacaaggagcctagtttctctcactcttcagacttctggcaatgcttatgttactggtaatctgtgatccacttttcttcccagctgtccagaatcatttagaaaagtcattaggccaggtgtggtggctcaggactgtaatcccagcacgttgggaagccaaggcgggtagatcactaagtcaggagattgagaccatcctggctaacatggtgaaaccccatctctactaaaagtacaaaaaatcagtcggacgtggtgacacgtgcctgtagtcccagctacgtgggaggctgaggcaggagaatcacttgaacccgggaggcagaggttgcagtgagccgagatcgtgccactgcactccggcctgggcgacagagtgagactccgtctcaacaaaacaaaacaaaaaagaaagtcattagacagtgataattgtgactcgtacaatttgtgctgtgcatctgcagctgggtccttgcaagcttcttggcaatgactcggttcatctattaatgactctctgtgcattccacaaggcagctattacaaacctatcccatgctcctcaaatccacagacacatcctcaccacgattttaaaaaaatcacctcactttttctttcctaaaagaaaaaaaaaaaaaaaagatcttcccttcacccattggagtgctgataaatgtttaacaactggttcttggagaggagaaaaaaggctctgatttgtagcatttctgatttccatggtgagggaatgttcttagggtggctgtggccactgagcatgaagctgggaagggatgtggcacctcactctcggagctggaaggagctgctccagcacactactgatgtcactctgaaatgctcctgacttcctgtttacttcccagccttctttctctctcagaagaaaggatgttctctgccttaggaagtctaagcccctattctctctccccggccctgggacctcctttatggtacaggccctctttcctgtgtatcttctgtctctagcttaactccacccacactagaacgaccatgctcactccttccatataaacctcatttaggccgggcgtggtggctcacgcctgtaatcccagtactttgagaggccgaggtgagcggatcacctgaggtcagaagttcgagaccagcctggccaacatggcaaaaccccgtctctagtaaaaatacaaaaactaactgggagcagtggtgtgtgtctctaatcccagctacttgggaggttgaggcagaagaatcacttcaactcgacaggcggaggttgcagtgagctgagatagtgccactgcactccagcctgggtgacagagtgagactccatctcaaaacaacaaaacaaaacaaaatcttgtttatacacctcaactatgaactaattgcaaaggttttgtgcaaatagattgttttacatctacactttaggtcctctgtcttttattactttctaagtcaggacagtacccatggttacataaatgaatgactttgtgttgacaaaataaaaaagaaacagtgtttagaatctcaaaaaagagatatccaaatttcttttttctttctttcttgcaactgttgatatttcactcttaaatgagcatccttggatgaatgatttgaatttcaacaaatatcctaaaaataaatgtatggtttctttcttaggtaatggagggattgtttatatgacgtatttttgggggagaataaagtaacacataccagtcatttgctgaagatgtgtcacttattggcatgtggatcacacaactaatcaactattgtggacaatctatatcttattacctctgatagagctgcccccgttgtctccagggagccaagaaagggtgatggaggaagacgtggtcttggagactgtaagccgaggctgatctggtggaactggagaggaaacagtttttagaaaacaagaattagtttttcacatctttaactttcctgaacagtcatttaccaactcatttttaacagccatttattaaataagtgtttcagtttgccaaaatatacaattcacttctgtcaaaatgtctatttagttgatatcctgggctaaagagatagaacggagtgaatctattatttaaaaaaaaattcagccacatttctacttggattcatatctaactcatttcctcaccagttccttgactgtctgagttatttatcactaattgaaatcttctttaaacttactaaggatacatgcctcattttactatgaatttcagccatgaaatttaagtgaaaaagataaatggcatccacttagcagttccgttcttctcaggatggaaaaggggaaggaggaaaaatagctagtgggaaaaagaattgcaaaaatcttcactttctaagctattgctccaagatgcaacacacacacacacacacacacacacacacacacacacacacacacacacacacagaaaatcaaaagcaggcctttgaactgcagaatatgaactggtctctcttacaaggcttgtagaatacatactggtaagtaagtctggatgggttctgagggcagaaacactaaagaaattcagaatcaggttatccaaatcatatagaaagcttcatataaaattcccttctcttttcctctgagagaagcctaatatattgacctatctcttcagagtcataatatagtgcctgtcttccaaaattccctggaattctcctgacttcaattaatttgaaattcaagatcaattttgcagcatttttagaaatatagttcttttcctttccttccatcccaccgagaacagtattgattttatttttacttgctgtaatctattaatgtgacaacacctaaatccaaagaagcacacactttgatttttctactaataaaatattgctgtgcatacaaatctgaactcaatcacttattgattgggatttacacaaaattttaacatgacaatcttttgaagttgtgcacattttgtgtatgatatcaagaaaaatacttagtattaaatacatagctaaatactacagcgatctacttagagctccagttactttcattttttaaaatacattgcatataaaaattgagttaattagcatacaaaaaagaccacaattcagacttgttttttgtttgtgttttctgggatacacttacatatatgtagagtaaacagtgcaattaatggaaattattaagaaggacttttttagacatgtacacataaagaaaaaagagactaggctttctgtatgcaaagatgttttgtatctcagtatttctgaggttgtgaatgctttgtattttctttgatttgtttaattatattttgcaaaatgaacatgtgttttctttttctgtaatatggaaacagaagttagctctttataagggctgattttaaaatttgttcagtgctactttttgcatagaaagcatacatgtaaaagatatcattaaaaagagtcctcaaatgttgtaccttgtacttgtaagtttaaaataatttcatcagatccccagttgttattggcaatgcagctgtaatagccggagtcttctgctttcaccgtgcgaataatgaagcttccgttgctaaagatgctcctccgcccatcaatcgttactagactgggtgtcccgttactgcctcacaggaagaaaaatgcacagattaaagaaattacaatccaaattagctgaggttggggaaaaacagaaagactctgtgaagcaaaccacacatttggaagcttcatatttcttgcattatgaaagaactaaatatgattacataatgaaaacaatcaatagctgtgtagctgaagttttcctttgtaaaaaatgttacgttgaagatgagatctgtgtcaagggcccagattctggctcaagtcagtggactcctcatctgtgccagagactgatgggtccctctttactccactctgtgggcactggagatatcctcattttggcaattctgggaatttcttctgtaggcagaagtgccagtttgaacaaatcatacaggggaaactaaaccttgggatcatttttagattcacttaaagtcacaattattcatgattttgacatgaaaaatgacatgtgatatctcaagagggtgatgagtttaccctagtataaaaagaactgcgtggccatcataaccactgctccggtggcagattgtccagtcctttggggtcattcccacaacaggcagaatgccaacttgaccttgggagctacatatttcatttggatgaaccaactttaaatgtatgagaaaagtggtcactaaaccaaaccattatttctacagtttggtcactacaccaagccattatttctacagtttatgccttctaagtgcttttgcttgaaaataggcattcttctgaatccattagatcacatttctatgctcataaatgaattttcgacccttaacttatatcctaatttcttctcctgaatagagatatagcactttaaaaagttatatggacagaccatatctcactcactctctccctctatcttggctcctattatttaaataattactatggagtatggagaaccagattttaaattagcaaagtcctaatgtactccatttcttaaagttctttctcagggtatttgagttatggttagttcactatctttaaagaagaagagataggtgttaaatctcacaatagccttggctgcattcatctcagttacatggacaatttacctgagagggtgcagcaaacttccacaataattgagttggttcaactactttccttgcaagcattctctcatgaactagaaggctctgaattaacagagggttgatacaataaatcagaccctttcagtgctaaagctgagattccttctctgccctcatctcagaagaattggtaggtttccttgagttttcactaatataaataaacacaaaattaggagaccactagacacaacctgagtatgtcagatgtaatctcttagagtctcactgaaggcatacattgggttactggttacctgtctttcatccatttgactgcaggagaagggtccccaacagccttacaaggcaagacaatgtctttcatccatggagtagtcactgtcccactgaaggtcaggattcgtgcaggagctgaggaaccaaacaaagtggaatcctgattactccacagacgtgtctacacagaggccaacatgacctactcaataagggcaatacctaaaaatggatgtgaagccaattcacattacaactgtcaacactactctctggtacccgggttatgaggaattgtcattgtaagaacacacaactagcagaaaattcccattgtagcattcttttcttctattgactaaacatgaggagtccaaattaaatatctagggcttcataagccaagcagctccaagctgtgttttctatgagcccaattatttctcaaagcactttaggaagcaatttacctcaacacaaaaactgctcattaaaatatactttaatatcagagaaagtagacaatacaaaacacaaaggccccaaagacgggaaggagtaaaactggaacaagttctacttaacaatttcccgactgtattatagcaagttgatctttaggacacacattaaggagaatgaacattttcagagtggcctctcttgaagaacaaccatttgcttggaacagtgattcagatgcccaaacaggagcatctgccaggggcatctggtactggtgcagccccaaggtagcagaagtcccagaagacagtcagaaaaagcccagggtgaacttgccttgaagtccagtgtggccagcaatgagaggttctagtgctacctccatcagtgagtcacaaaagctgacagggacaccacacacaagtcttccagaggaaaacaatctgctcagtctttgccatacattgggacattactttctggggtgtaaacaggagcccggggcttctcctgtcctttgttttagccagtatgcttcagacactgtcatggagctggggacatagaggaaacaggtgcccctacaggagctcaccctcgatggatgcacagaccggaaaccataggtggaaggcagccttgaactgattcagagcccataaaaatgggacaaatgtgagacccctgcaccatttctgggttgagggtttgcattggcaaaggaagatgaggagaaggctcccccagggaagctctagaatccctggaagggcagagtacccagagccaagtcattatgcagccatcctagtatagaatacccacattagtcactaggatctaccagaccaaatcatacatttttgcctctgggcactgtgggcaagagtagagagaaaaagaaaatgccagagggcttagaagctggaccttgttttttgttgcagcaaaacccatgtttcaagcaatttccctggactgagatgaagtattctaaggcagggcccatttcatcagtcattgacatttctgattttgcatcatgataacaaaaaggtcctgattaggcagcatcagatttcctgcattggtagcttttggcattttctttttcacacacttcagacagttctttagagagtagagaatgtcctcagcagtaaaaggcgggtggctagagaaattcagctagagttaggggctttccagctttataacagtcacccactttaagaaatatgttttacatcaaactccagaagctacacatgcattgggatgttgtgtatgtgcaaacaaagttgcatgaataaagacttcactgtatgtgatgcattctgatattttctgtcttttttaaaccctagtttagtctagtctagttgatttgactctgttccactctattccattgttgttctttaacattctgggcataacccctcaaattaactccaggacttatgaatgcttttccattagcaatttaaaaaatacaagctagagctacttcatcttcaagcccaacaacccccatgctatcgctcaatgcccattttgcccattttagacggctgaaatttaaagggtctctagccagaaatgtatgactgggcaactcaacacactagacctggggcagccaagagaatcccctagaatctttgtttaaaatgcaggttcccaccacagccttgtggattcagcagctctttcctgtacttggggcatctgccttttgacaagcatcccaggtgattctgatgagaaactgaacccctctgcaacctggtgtcccctctgattcgggtcccgtttgttctcagccatggggccaggctctctgtgccttcgtgtcctggaccccttcctaggaggggcttcccccaggaccagtgccatggccccattctgccactccctccataaaagcagtggtcctcctcttcttcaactgtatctgaattttggaccctgctacctgtcgctagactgctgctggtctgccttgacttcccaacaactacagaataacctgtctcaatctcctctgctgtggacatccccatccctctaggatgggcctttcagccttcatggtttgccagtgtctgggcttctgggtgggggctgcccaactgactgtctgctccatcctgaggcactccctagcttatcccctttccagaaaacctacctacagcaatcctaaccctgagtcaacctcccttaagcatgaaaagttgaacatttctggaaaaaaaatccacgcaatagagcatttggagattgaccaccatttaggatcatcaacctcaattgaactgtcagcactccctgctggtcttactgtttctttagtaaatgtcctccccattccctgcaacgatggcttcctgctgtccctcctcttctcacacttctgggcttccctccactatccccaaattgcctaatgcttcagagacaccatccaggaaccctgcatttccagccaccaaatctgtgaacctactggcatttcctcctctaaacctcagtgctgtggtcgtgggctctttcttatgtattgttgatttctcgtttctccctctctactgggatcttcccgttaccacataaacatgctctgatggcaggcctcatgaaaaataatgaacccagagcctttcctcgaatgagagcctccctccccctcccagcttcttctcttggttgtcacttcttccaggtgatgtgtgttgaaggaatgttctgcccagtcagcctgcccctcacctcctacccactttctcacctgactcaggctcatttctgcatgcccctccacacccactgatgctgctcacaggaaggtcaccacgatcttccgtgtggccactgaggggcattttcgcctggttttgcctgactttccagcagcagcagcctcacctgaccactccctccttttgcaagcatctgttttgaatccacagcctaacaccctcctggctctgctgcctctctggcttttccccttttcctttgcctgctcccactccctttgagagtccgtcctgcaccttcatctctcctccatctctcagccaatctcattcccatcccaggtgtaagcgatatccagacgctgacccgcctgaatttctgcctcctgccagatgtctcttgagagccaggacatgcctcagtgcacagatgcctctgagtgaatggctcttcgtcaccttggattgaacccctccaaatgtctgtacctcctctcactggcttcaaaatccacttcttccatggtcttcttcatcaagaaatcgtgcctccacttatgctaactcatgtgagaatttgggtgttcattcttgctatctccttctccaccctcctccatttctgcctctctgcagtccattcaggacagagagaccaggtggtcttaaaaagcacacccgccattagttgtaagaaaggcatttaattaggatgtctataaaaagggaaactaggtgtgaggtaaatggcaactctctgtactatcatcacaatttttctgtaaatctaaaactgttctaaaaaataaggtttatcacacacacacacatgcacacagagagaaagagagatcatgtgcctcccttgcttaaaaccctacaccatctccttatttctcttgcggcaaaatctgaaatccctaacacagtgttgaaaacccagcatgatcaggtccctgtcttccttcccagcgtctctgggaccactgttccttccccggccccagcagggtccagtgtcctggacctcccacctgctaaatctttctctgcaggagcttctgactgctcacttcttctctcttcacataaccgcctttgcttgtgctcagggaccaagtgtgtcctccatctgacactccaggtgaggtcctctcacactatttctttatagcacttactacagtttgtctctatgcatatacttttgtgatgctttgtttactgactgtattagtctgttctcatgctgctaataaaggcatgcctgagactgggtaatttataaaggaaaggggtttaatggactcacagtgccacatggctggggaggcctcacaattatggcagaaggtgaatgaggagcatagggcatgtattacatggcggcaggcaagagagcatgtgtggtggaactcccctttacaaaaccatcagatctcgtgagacttactcactgtcatgagaacagcacaggaaagacctgctcccatgactcaattacctcccactgggtccgtcccatgacacttggaaattatgggagctacaatccaagatgagacttgggtggggacacagacaaaccatatcactgactggctccccaccaaactgtaagcttcagggggtcagggagtgaacacatctcttaaaccatctcaaaagactcctctgggctctccaaaccctgttttcttttccctggtgggtccatgcctttattctagacaataggatattagtaaaaataatgtatacacttccgtatctggctcatgaaaacctctcatcaaaccctccatactcccttcttcccccatctatttagctgtaaatgaggagaaatccagggttgtaaatcataaggtggaaggggcctggatgcctgaatcaccatgtggaacaggccacccaagagagccctgaccaaaaatacctctgttggactatattattatgtgaagccactgagatttagggaacatttatttcagcagtcagcctcccttgaccaaatcctctgtgtccccagcatagaccctgacatacaacaggcactcaaaatgacttattaaatgactggaggacattgaatttccccaggcaagacctgcttctgtgagagttttcaattgttcccccactgagtaagtcataccccactgcactagccaggcctttctggctgtgtctagagatagaactttgaaagcacaaaggaaaggaagaaacattattgctaatcctatgtgttttgttgcagtgtttttttgtttgtttgtttttgttgtttttttggtaaatcccacagctcagtccttatgtccaacattttccttggtaatcatcattttctcattctcagggagtggctggatatcatgaccaaagagtgtaatacataaagtaagtcccccagtttatttcccttaccaacttacttattttctatctgtatttgagctcaaaatgtgacacccctcttttttcccctcactgctttattctgcctatttcttaactatctcattaaaaagcacatttttcagagaattcttggaggtaaaattggaatcttggaatgttcattcttgtctttcaggctatcagagaacatattagtaataagttgccactgttctataactcaaaattaggggcaactcctgctggcctggaattgtgtcgtaaggaaattgacttattatgaatgctaatttagggggttcctggaaacactggatggccgtgattaccagaagagcaagaataccccgtgcctgcgtgtgctttttaaggaccagtttaacgtacaaatgtgaagatattatattcactttaaggaactttttattctttggtgactcctacttcctgctgttacttaaagtctttgcttatagcattctgtcaacagatagtgaatgattttcaaatatttttaagcttgcaaattccatagactataaaatagacatttctcattaagaagtgtgatacctgattttgctgaaagtagaacatccttgggaaaatgccgtgtaatgattttcagctactccaaggaatgaatgagggctcctttcctaattttcatagacacttccattgtaaggccactcattctcagctttgtgtttacctccagggaattacttttccatgggacagaagctcagagcttgttagccacaaccctgtttcttgagctaaaatgtgatattctggtttatttgatttttaggaaagtgtaagttttatttcaggtaaaatagagacttaaaaacagtcaagttacaacaggaaatgaggtccttatagccactgcctaccttttgctagtggctcgactgtgatgatttcactgctgttgcctcttccggctgaagtaacagccaccacccagacgctgtactgacgattcctactcaggttgggaattctgtaggaaaacgagtcgggagaggcctcaaactcgctgatcacctgtaaaaagagacataagtgttcccacattcaaagaagcatgtggcaaaaatggatttcccgaaggaatggtcatgaacatattaaatatcataacaaaaaaactcaactcactctcctctaaaaggctggctttgcaatataaaatgtaactggtaagtttaagtgacccaccatctacatttttctctgcagcagctttgatggccaccaataaataatttacccctttacattacaggccacagcacttctgtatttggctgagatggagtaacaagaaccagatttaccctcccacctgaaacaactgaggaacacacaccatccataaaacaatggttctaaaagcattgcacatcaggtaataaatgacagtgatctctgaaagatgggaaacgaatgaagaaaaccccacaatcgcagagattttgcaatttgtagggcagtgtaaattttatttctgataaaatagagagctccacctcctcaactcgggaggttggcagcctttccaagctaaggaggcagagctgagagcctgaaggaagctagagttcacaaggaagagcactggaaagagagctacacacaaaggacaagctctggagattgaagagggtcctacttgggtattcagctgagcagatccatggatgcatgtgaggaaactacccaaggccagggaaagacacctgaaagaattggaggtcacggtgcctaatgctcacacagggatgggagtagtggctgttctcaccagttgggttggaaaacatcaagattcctcgagcattgggtatagtgcataagggtcttaccacaaaggggaaataattagccccaggctgaataccactccagtctttcctaattattcttaaaggcaagacttagagagaacaaattattcctaaataacttaactacatccaagaataaaggtcaagaatatttatagaatttatagaaattgaagcatgtagtactccaaaaggtgaagttcacaaagtttaacacctactaaaatatttccacaaacaaatagcccaaatatgtgtcacctgatgactggataaacataatatgtcacagcgataccatggagtctgtattagtccattttcatgctgctgataaagacatacccgagactaggtaatttataaataaaaagaggtttaatggattcacagttccacatggctggggaggcctcacgatcacggcagaaggtgaaaggcatgtcttacatggtggcaggcaagaaagaatgaggccaagcaaaaggggttcccccttgtaaaaccattatatctcaggagacttattcactacgaggagaacagtacagaggaaactgccctcatgattcaattatctcccaccaggtctctcccacaacacatgggaattatgggagctatataattaaagatgagatttggctggggacatggagccaagccatatcagagtgttatgagataatagaaaggaatgaagtactgataaatgctataacttggataaatcttgaaaacattatgctaagtgaaaggagccaattataagaaaccacacatttgtgattctcttcatttaaaatgttcagaataggcagatcgatggcaacatagattagtggttgtcaggggcagggtaggggaaggggaaaattgggaatgactgctaatgggcgtgcagtttcttttcagggtgatgaaaatgttctaaaattagatagtggtaagggttgcataactctgtgaatatactaagagccactgaattgttgaagttaaaagtgaatgacatctcaataaagctgtcataaaaatttccaggaaaacataattcataagaagaaatcaatcaatcaaaattcacccataattggcacagacattagatttatgcaaacaagggcaataaagtagttataattgtattatagcggtattataactgtatatgttcaaaaatttaagtagatatgatacaaaaagacctaaattaaactcaaaatgaaactataatgcatgaaataaaaaatacattgaacttgattagcagcagcgtagatattgcagaaaaactgattagtgaacttaaaggtgtggaaggaaaataaatattggggcccccaaatcactaagctaaagggaaaagtcaagctgggaactgcttagggcaaacctgcctcccattctattcaaagttatccctctgctcactgagatagatgcatatctgatggcctcctttagaaggctaatcagaaactcaaaagaatgtaaccatttgtctcttatctacctaggacctagaagccccctcctcacgagccccctccccactttgagttgtcccgcctttgcttcaagttgtcctgccttttcagatggaaccaatgttaaaaaattggttgatgtctcatgtctcgctaaaatgcataaaaccaagctgtgctcggaccaccttgagcacatactgtcaggacctcctaaggctgtgtcatgggcacgcatcctcactttggcaaaataaactgcctaaattgactgagacctgtctcagatatttgaggttcacaacacatattaataaatgatacatagaaaagagaataaaaaagttaacagggcattagtgagctatggaaaaatatcaggctgcctaacatgcacatagtggagttcctaaaggaggggagagagacaggaccaaaaaaaggttgtaaaaatagtggttgaaaaatttccaaatttgatgaaaactgtagcccgcagagccaagatactcagtgaattctagccacaagaatattaaaaaaaaaaactgtaccaaggagcatcataatcaaactactcaagagttttagtttcagtgctagagagaaaatcttaaaagtagccagagaaagtaaatgttgtgtaaaggggaacaaagataagcatggcagccaatttcatttgaaaaacaatcaaggtaagaagacagtggaatgatttctttcaagtactgaaagaaaaaaatcaacctagaattctatattcaacaaatataattcaaaatgaaagtgaataaagacttttttcagatacataagaagctgaaagaattaatcaccagtagacccacattacaagaaatgttaaagaaagtccttccagcagaaggaaaataataccagatagacagagacataaatgtacacaaataagtagaaaaaggaggtaattatacagatacatatatatggtatttcttatttaaatattattaaaatatggttgatagttaaaaacaataccaatgtaatgtgggtatataatataaataaaagtaaaatgtttaacaatagcacaaatgttgggaggaaaaaatggaagtatatgattgtaagtttcttatactatatgcaaagtgtgtaataccgcttgaaagtacactaagatgttaaaagtatatgctgtgaattgtaaggaaactgctgaaattacaaaatatagcataaaataaagctaatgaactaataagataaataaaatggaattacaaaaaaaaccccaaagaagtcagagaaagactgacaagggcaacaagtagcacaacagcagcagaactcaaatagcaaatagcactacacagagttaaacataaacatagtaataataattttaagtataaatgatctaaatatattaaaggcaaagattgtcagacctgatataaaagcaatatccgactatatgctgcttacaagaaatgtacttgaaataggccaggtgcggtggctcacgcctgtaatcccagcactgtgggaggccgaggcaggtggatcacgaggtcaggagattaagaccatcctagccaacgtggtgaaaccctgtctctactaaaaacacaaaaaattagccgggcgtagtggtgggtccctgtagtcccagctactctggaggctgaggcaggagaatggcatgaacccaggaggcggagcttgcagtgagccaagattgtgccactgcactccagcctgggtgacagagtgagactctgtctcaaaaaaaaaaaaaaaaagaaagaaagaaagaaagaaagaaagaaagaaagaaagaaagaaagaaagaaagaaagaaatgtacttgaaatataaaaacacaaataggttaaaaataaaggaacttaagtgatatcctatgataacactaatcaaaaaaatatggaatggctatagtaatatcagacaaaatagatttaaaagcaaaggatattaccagtaataaagacagaaatttcataacgataatggggtcagttcatcaagagaacataacaattctaaacatttattcacctaatattcacctattattcaaagatatgaagcttggttattaggtgaataaacgtttaggatttattattacatgaaacaaaactaatggaacttcaaggagacatagacctagataggtcagaattgttccttaaaaagccatgtgaagtaggtggagctggatccattttatagatcaggaaactgaggttcagagaaagtaagtgattcactgatgtcacaagaccagacaactgcagaacaatggctccagctcagggcctctggtcccaagtctggtgctatttcctcacactttatgctgtcaattagaagtgaccaaaacaagaaggacttacttttactcttgttagcttttcaataaaccttacatgcctcagcaggctgcataagttacaataccagtcatgcaattaaacaggggatttaaatcttcactatatctcttaattgtcatacaacctcatgcttcctcaacaaaacataatgtcagataattacttattgtcaaaactttaatttgtgggtacacagtgtcagatgatttggagagactcttgcatggattccctagatacatcactataatctagcatgcacgtgcatgtgtatgcactcatttacacctcacctccacccccctcccactacaacactccagtcacgtcttagagtattatgggaaaattagtccctctagaagttcagagggaatttggcctgtttcctgataaaccaaagagacaatcctgagactgtatgtacttgcattgtgtgattctccaaggctatgtcattgccaaattaattttacaaagcttaatgatgtgcaaattctaacaattactcttactgaacattaagcatcaggaaagcattaagatatatttataaaataaagatctttttctgtgtagacaacatagcttttagttaaaactccatacttatcctgttgacaaggtaaaattcgttcttgattacctccaaaacacacactttaatttttgcctgtaacataatgcatggctaaaatcaacaataaaatatgactttttatgcaacaagatttgtttcatcatttatatagaagactaatcaagaattgaagtaaaaaaggtatattcatagaaacttccttaatttctccgtaggttaggatgaaaaataataacgtcaagctgttagtggctcctattggttatttgggtaagttagttacactgatgtcaccaccctttgatgccactgtgtattcctctgaggactgccataattaggcacaattttcctggtcttagtagaagggcaagcagaaagttgataactgaacaatttaaaccatcagagttgatttattttctttggaatatatgtaactggatattaaagttgactcttcctgttctctggaagttttagcgatgatcttaaagcgtgagaatgctcctaaagatgccagtgccttctttcctaacaagagctgtgaggccacctgggcaggacttgctggttctcatgttttgccagtcatccatttccaggctccaaaagaggctggggcaggaataaggattttctgttgagagaggtctgtgagtattccctcttatgggtggaagagggctttgagctctagggaatctctcggagaacttggagtctgaaggacacagagcttggtaagtgagccacacctgagaaggctaatggcgaaccacagtggcagaggttagccctgctcacaacaggagaggaggctgggctggactggccacgcctcctagagtgaagcagggtaaggatgcctactggttgaccctagaggacagagcaagcctggatgtcttgagagagagaaccataggcatgaaatgcctccaacagagggatgcagtgtaaattatatagtatttattgtaaacagaatcattagctatggatggtgcataactcaatcattattaaccattttaacagtaggtaggagaaaaaagaaaaaaagagcaaaatgggaagaaaataaccagaagttctctcagtgtagtggagccaatctagttgattaaatcctttttaatgctcagccaaaaatgcttgttctgaaaagaagggatgataaatatcatctccttttgaaatatttccctccatattttattaagttaggatagcatggactatatttatatttcattaattttctttttattggataccagattttccaacacaacaatccaatagtgtgtaaactgacttgctaatttctacatgcatattttattacgtagcactctcttccaaatatagagaatgttcaatgagaagggatcactttgatttccagatttcgcctgatatatcagctgggttgctatttcagagactctgaatcttttttttttttttttttaaagaaacaaagcaaagcttcgctatcaaggacaacagataaacactgcggtataaagaagggcaaactcacaatggagtttcttagggattaatgaaccaaatgtggcaaaaggagaaatctgtggggaagcaacagagacacttttcttaatatttaaatatttcattttcttcaggtagactttgaactctccagtctcatcttctttagagttaagacagacgtgtcagtcatcctagattttgttatgcctaaagtgtgaattaattttgagtggactacagtaattgtgctaaccatttgtttgaagagaagacataagagttcctttgtgacctgtggaaatacagaaacagccaacattacgaagttgccgccaggcatggacttgagggatcccatcccccatgtccctgaaccagaatgccagggattcccttccatggcttatttttaatcctgctctgtctatgcccagcttgaggaagtggatgggacatttgtggactggggttgccaattattttgcatctgtcatatattcctcttggctagctgaggaaaaagcctgttatttctcatctaaaatgtgtttaaacatgtaggctctatccaagttgagaagcaagccaacatttattattaattaatcacttctcaattgaaaggctctaagtggctgccaagttactgatttcttggtccaccagataacatggtggcatgagaagaacagggctctctctggctcagcggtccccagcctttttggcatcagggacagatttcgtggaagacagttttttttttcacagatggatggacgtggtaggatgggatggtcttgggatgaaactgtttcacctcagatcatcaggcattagttggattcccataagaagcatgcagtataggtccctagtattagtccgtagcccgggggttggggaatcctgctctaccgatgtcatgtaacaggggcaatccacagtgttcttaggggaagatttgggtatttggtctgaggacacacacataaaatgtaaaatatgcatgttgcttatgtaatgaaccatctcaaatactattcttacagtgggctggtcatggtttttactgtgggaggtggtgggggggggtccaggcagacactgctgccttcaaagtatggaggtctgtggataagggatgttggcgagagttataggaccccatgagccagacatagaagcttgttggactatcgttctctcctttgggctgtgggaagaaaatctaggcaaaagttcttagcttcatgcctcgtaataggaagggcttgtaaataattactgagtttcaattaatggtcatttactgagttcagttgcagtgtgtagattataaggcaagttcctgcccccggggagcaagaagtgaccacagcttggcaaacagattaatttaaaatgaggcaccatagaagtctgaccaattcctactaaaatttagatataaactcgtttgaacctttctctaaaaccaaccctgtcatagttgaagacatggatgaatatttataagatgcctaaaaaataaatggaaacttcatatatttgttttaaaaaatatttatagcaaggttttacaagacttctgacatgtttgcctccccaaagccgtatccagagtggaaaatacagtaaatgggataaatcttgtgacacccaagccagagcgttcacatttcaagcgttttgtctttgtatgttactgctttaggtctgctgggtagagtcgtgggttcctaaggaactaaatgtgcacagtttactcttccagtcaaaagagtgtaagggttgtgaggaagttagttttctcctagtgcttcagggtcaactcatggaaagcctgggaacagcgtcttctagacctgccttcattccacaattattgttgccttgtggtgttgatataatatttttcttttcatgtgtaagatgcttttgaccagtaaataagatataattagccacagtgaggcactttaaacactctttggtcatgtctataaaactagacgtttacccaataattgccaaattcatttccgaacccctcacattacttagcttgtagctgcacttgtaagaccttgcagagccttctctagtcctctcaatcaggggctaagtctgccctttgtctttcatagcctttgcctttattccactgtgggttatggtcttgcatgtgcttactgcatctccccaggggtcaggctccccgacccatccctctactccttttactcacccatccctctactcactctgcagggaacctggttcagagcattgcttagagctgggactcaatgaccagtaactggaatacactgaagaaattcttgttgtactaggtgagtttagtaatgacctagaaatgatttgagtacgataggaaataatgaggataaaatgactacaaagccataggctgttcatgtcaaactattcagcctgtctgatataaaaggaattctacttttaaaaatttcaattaactttttaatgaaaaactaattctataaggaaatgtgatgttttaaaaagctctgatagctaattgttaacatgcaattaaaaaaacttgaaggctgtgatttcatagatagaatgtccacagcagtgaaaaaaaaactcccccaagcaataaacaaaattgatagctcttttaattatagggtaagggaacttttagaatgcttaacatcttcttgtttagtggcaaagaaatggcctggattccattaagaattagcagttcactgcattaatttaagatttttaaaattcttatgtataatatattttgatctaatttccattttatttcacagttcccatctataaaagaagatgtcatggcagaaagatcttcctaaaggcataggttgagaggccaacattggtagaaatgggataacagccaggcaattctggtagtttcctctgcctttcactgagattactgtagataccattacatatatgactatatatatgactatatatagactatgtatataactatatacatagactattggctacttttaaaaagcctttcaaatataaaatattttatatatgaccatatatatatatatgactatagataccattatatatatgtctatatatatgactatatgtagactatatatataattatatacatagactattggctacttttaaaaagcctttcaaatataaaatattttatttttggccttccaaatataaaagttattgctataatgttttgcaactatattaaagttgatatccagagaaggcatgagaaaaactagtttcttgatgtaattgtttagaattagaagcaccatccaattagcccaggtggcattacagatacttatgttaacaggctctttccaaccgatataatctccctttgctacaatttttcctcatccccttttcattgtcataccacctgccatgaaaattatctatctgtcaaagttacattattaatttaacttgattgctgtcacctattcaacaaattctgtacaaaaaaactaatttgttatcatatagtttctcacatacaagaaattaatgagaaacacaattcttagtaataaaaataatatatgcagaatttacaaaattgaaaaaaatagctctttccactagtgttaattgaaaaatgatttaaagccaatttatttccttaaatagtacaatatgtctgtgtcaggccaagtcaaaaagataagatgttttcaaagctgcaatcttccaaaagctccaaaagctaattgataaaaagggcattttagcaaaactttggagacagtaaaaagatcagaggttaagagggtgggatgaataggaggagcacagagggttttcagggcagtgaaacttctgcatgatgctataatggtggatccatgtcatcaaacatttgtccaaacctataaaatgtacaaccccaagagtaagtcttacataaactatgaacactggctaataatgatgtgtcaatgtaggttccaccattgttacaaatgcaccactttattgggggatgtcgatagtgggggaggctgtgcagtaggggcaggggcatttggaaaatctctgtaccttcttctcaatttttctgtgaacctaaaactgcttaaaaaataaagtcaagttttttaaaggcattttagcctgtggataatcagaaagctctacgcagcaatggggaagtacattcagggtggcatacactaagctacctagtctgaatgaatgctacctcaaagctagaatgcttagtgacaggttatctgacaaatcaggcaggcagtcttatgagactgagcttcaaaagagatttccagggcctctttctgtatgaaaattttaggggagtatatgcttaagttttctttgctctataaattacatgattgggctcagaattttaaaggccaagatttctaccttgagtataggccatctgcattttaccagttatagcaattgaatgatttcacataatgcctagtggacaaacaaccactgagaacaatatgagaagaaaactgaaatatagcttcaacagaaagattgagtagttattggcttgttcactgtgtgatatgggttggctgtgtccccacccaaatctcatcttgaattgtagttcccacaatccccatgtgccgtgggagggaccccgtgggaggtaactgaatcatgggtgtggttaccctcatgctgttcttgtgacagtgagtgagttctcatgagacctggctttataaggggcatttcccgccttggttctgcacttcctcttgctgctgccacgtgaagaaggacatgtttgtgtccccttccaccatgattgtaagtttcctaaggcctccccagccatgctgaactgtaagtcaattaaacctctttcctttgtaagtcactcaatcttgagtatgtctttattagcagtgtgagaacagacactgtgaataggataacagggaaaaaagaccactattaaatgataaacttataaaaaacaacatcgacttcccttccactttcttaaagaatagaagtcaaataaataggcaaaaattgcacacaaaaaactgagaagatttagaaccacattccatatctattgagataatcatgtagtttttgtctttacttctgtttatgtgatgaatcacatttattgattgagtatgttgaaccaaccttgcatcctgggaataaagcctacttgatcatggtggataagtgtattagcccatttttatactgctatgaagaaataccagagactgtgtaatttataaagaaaaagaagtttaatggactcacagttccacatggctggggaggctttaaaatcatggcagaaggcgaaggaggagcaaaggcatgttttacatggtggcagacaagagagggtgtgcaggggaactgctctttataaaaccatcagaactcatgagacttattcactatcatgagaacagcacaggaaaatccgcccccatgattcaattaccttccaccgggtctttcccatgacacatggagaaaatgtgaggtacaattcaagaagagatttgagtggagacacagccaaactatatcaataagctttttgatgtattgctggattcagtttttcagtattttgttgagatttctgcattgatgttcatcaaggatattctcctgaagttttcttttttgtcatatctctgccagatttgggtatcaggatgatgctggcctcatagaacgagttaggaaggagtcccccctcctagattttttggaatagtttcaataggaatggtaccagctcttctttgtatatcttgtagaattcagccatgaatccatctaatcttgggcttttttcatttggtaggctacttattcctgcctcaacttcagaactcattattggtatgttcggggattcaatttcttcctatttcagtcttgggagagtgtatgtgttcaggaatttatccatttcttctaggttttctagtttatgtgcatagaggtgttcataatattctctgatggttgtttgtatttctgtggggccagtggtaacatcccacttatttattctgattgtacttgtttgaatcttgtcactttttttctttattatcctagctagtggtctatctattttattttttttttcaaaaaactagctcctggatttgttgatccattgaatggtttttcatgtctctatctccttctgttcagctctgattttgattatttcttgtcttttgctagctttgggatttgtttgttcttgattctctagttcttctagctgtgatgttaggttgttaacttgagacctttctaactttttgacgtgggcatttagtactataaatttctctcttaacactgccttagcagtgtctcagagattctggtacattgtatctttgttcttattagtttcaaagaacttcttgatttctgtcttaatttcattatttacccccaaagtcattcaggagcaggtcattcaatttccatgtaatttgtatagttttaagtgaatttcttagtattgattttgaatatgattgtgctgtggtctgagagactgttacgacttcagttcttttgcatttgctgaggagtgttttacttctgattaatatgatcaattttacagtaagtgtcatgtagcaatgagaagaatgtatattctgttgtttgggggtggagagttctgtaaatatctttcagatccatttgagttctgtagatatttatcaaatccatctaattcaggacctgagctcaggtcctgaatatctttgttaattttttgtctcaatgatctgtctaatattgtcagtggggtgttaaagtctcccactgttattgggtgggagtctaagtctctttgatggtctctaagaacttgctttatgaacctgggtgctcccgtgttggatgtatatatatttaggatagttagatcttcttgaattgaaccctttaccattatgtaaaatataggatgatgtaaacttaggacagttagatctttgtcttttttgttctttgttggtttaaagtctgttttgtcagaaactaggattgcaacccctgcttttttctgtttttgatttgcttactggattttcctccatccctttattttgagccaatgtgattatctcaaatagatgcagaaaaggcttttggtaaaatccaacatccattcatgttaaaaactctcaataaactagttattgaaggaacacacctcaaagtattatgacccatatatgacaaacccacagccaacatcatactgaatgggcaaaagctggaagtattccccttgaaaactggcacaagacaaggatgccctctctcaccactcctactcaacacagtattggaagttctggccagggcaatcaggcaagagaaagaaataaaaggcattcaaacaggaagagaggaagtcaaactatccctatttgtagatggcatgattccatatctagaaaatgccatcatctcagcccaaaagcttcttaagctgataaacaacttcagtaaagtctcaggatagtgcgaaaatcactagcattcctatcctctaacaacagtcaagctgagagccaaatcaggaataaactcccattcacaactgccacaaaaagaataaagtaccttggaatgaagctaactaggatggtgagagatccctacaaggagaactacaaactactgctcaaagaaatcagagatgacacaaacaaatggaaaaacatttcatgctcatgaataggaagaatcaatatctgaaaatggctatactacccacgcaacttatagattcatgctattctcattaaactaccattaagattcttcacagaactagaaaaaactattttaaaaattcagttggaaccaaaaagagcccaaacagccaaggcaatcctaagcaaaaagaacaaagctagaagcatcatgctactggacttcaaactatactacagggctacagtaaccaaaacagcatggttctggtacaagaacagacacatagaccaatggaacagaataaagaacccagaaataagactgcacatctacaactatctaatcttcaacaaacctgacaaaaacaagcaatggggaaaggactccctattcaataaatggtgctgggataactagctagccatatgcagaagattgaagctggctcccttccttacacgatatacaaaaatcaactcaagatggattaaaaaatgtaaatgtaaaacctaaagctaaaaacactctggaagacagcctaggcaatactattcaggacataggcatgggcaaagatttcatgatgaagacaccaaaagcaattcgcaacaacaacaaaaatggacaaatgggatcaagtaaatgaaagagcttctgtgcagcaaaagaaattatcaacagagtaaacagctgacagaatgggagaaaatttttgcaaactatgcatctgacaaaggtctaatattcagcctttataagaaacgtaaacaaatttacaagaaaaaaataaacaatccgataaaacgtgggcagaggacatgaatagacacttttcaaaagagaacctacatgcagccaacaagcataggaaaagctcaacatcactgatcattagagaaatgcaaatcagtggtgtggagccaagatggcggaataggaacagctccagtctacagctcccagtgtgagcgacgcagaagatgggtgatttctgcatttccaactgaggtaccgggttcatctcactggggagtgtcggacagtggacgcaggacagcgggtgcagcgcaccgagcatgaggcaaagcagggcgaggcatcgcctcacccaggaagcacaagggttcaggggattccctttcctagttaaagaaaggggtgacagacggcacctggaaaatcgggtcactcccaccctaatactgcacttttccgatggtcttagcaaacggcacaccaggagattatatcctgtgccttgcttggagggtcctatgcccacagagcctcactcattgctagcacagcagtctgagatcaaactgcaaggtggcagtgaagctgggggaggggcgcccaccattgcggaggcttgagtaggtaaacaaagtggccgggaagctcaaactgggtggagcccaccgcagctcaaggaggcctgcctgcctctgtagactccacctctgggggcagggcatagccaaacaaaaggcagcagaaacctctgaacacttaaatgtcactgtctgacagctttgaagagagtagtggttcccctagcatgcagctggagatctgagaacagacagactgcctcctcaagtgggtccctgacccccgagtagcctaactgggaggcacccaccagtggggcagactgacacctcacacggccaggtactcctctgagacaaaatttccacaggaaagatcaggcagcaacatttgctgttcaccaatatccactgttctgcagcctccgctgctgatacccaggcaaacagggtctggagaggacctccagcaaactccaacagaccttcacctgagggtcctgactgtcagaaggaaaactaacaaacagaaaggacatccacaccaaaaccccatctgtacgtcaccatcatcaaagaccaaaggtagataaaaccacaaagatggggaaaaaacagagcagaagaactggaaactctaaaaatcagaatgcctctcctcctccaaaggaacgtagctcctcaccagcaacagaacaaagctggatggaagatgattttgatgagttgagagaagaaggcttcagatgatcaaacgactcagagctaaaggaggaagtttgaacccatggcaaagaagttaaaaaccttgaaaaaaattagacgaatggctaactagaataaccaatgcagagaagtccttaaaggacctgatggagctgaaaaccacagcatgagaactacgtgacgaatgcacaagcctcagtagctgattcaatcaactggaagaaagggtatcagtgatggaagatcaaatgaatgaaatgaagtgagaagagaagtttagagaaaaaagaataaaaagaaatgaacaaagcctccaagaaatatgggactatgtgaaaagaccaaatctacatctgattggtgtgcctgaaagtgacagagagaatggaaccaagttggaaaacactctgcaggatattatccaggagaatttccccaatctagcaaggcaggccaacattcaaattcaggaaatacagagaacaccataaagatactccttgagaagagcaactccaagacacataattgtcagattcaccaaagttgaaatgaaggaaaaaatgttaagggcagccagagagaaaggttgggttacccacaaaggaaagcctatcagactaagagctgatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggccggccctaaaagagctcctaaaggaagcactaaacatggaaaggaacaaccagtaccagtcactgcaaaaacatgccaaattgtaaagactgtcgaggctaggaagaaactgcatcaactaacgagcaaaataaccagctaacatcatgatgacaggatcaaattcacacataacaatattaactttacatgtaaatggactaaatgctccaattaaaagacactgactggcaaattggataaagagtcaagacccatcagtgtgctgtattcaggaaacccatctcacatgcagagacacatataggctcaaaataaagggttggaggaagatctaccaagcaaatagaaaacaaaaaaaggcaggggttgcaatcccagtctctgataaaacagacttgaaaccaacaaagatcaaaagagacaaagaaggccattacataatggtaaagggatcaattcaacaagaagagctaactatcctaaatatatatgcacccaatacaggagcactcagattcataaagcaagtccttagagacctacaaagagacttagactcccacacaataataatgggagactttaacaccctactgtcaacattagacagatcaacgagacagaaagttaacaaggatatccaggaagtgaactcagctctgcaccaagcggacctaatagacatctacagaactctccaccccaaatcaacagaatacacatttttttcagcaccacaccacacgtattccaaaattgaccacatacttggaagtaaagctctcctcagcaaatgtaaaagaacagaaattataacaaactgtctctcagaccacaggtcaatcaaactagaactcaggattaagaatctcactcaaaatcgcttaactacatggaaactgaacaacctgctcctgaatgactactgggtacataacgaaatgaaggcagaaataaagatgttccttgaaaccaatgagaacaaagacacaacataccagaatctctgggacacatttaagacagtatgtagaaggaaatttatagcactaaatgcccacaagagaaagcaggaaagatctaaaattgacaccctaacatcacaattaaaagaactagagaagcaagagcaaacacattcaaaagctagcagaaggcaagaaatagctaagatcagagcagaactgaatgaaatagagaaacaaaaaacccttgaaaaaatcaatgaatccaggaggtggttttttgaaaagatcaacaaaattgatagaccgctagcaagactaataaagaagaaaagagagaagaatcaaatacacccaatacaaatgataaaggggatatcaccaccaatcccacagaaatacaaactaccatcagagaatactatacacacctctatgcaaataaactagaaaatctagaagaaatggtaaaattccttgacaaatacaccctcccaagactaaaccagaaagaagttgaatctctgaatagaccaataagaggctctgaaattgaggtaataattaatagcttaccaaccaaaaaaagtccaggaccagatggattcacagccaaattctaccagaggtacaaggaggagctggtaccattccttctgaaactattccaatcaatagaaaaagaggaaatcctccctaactcattttatgaggccagcatcatcctgataccaaagcctggcagagacacaacaaaaaaagggaattttagacctatatccctgatgaacatcgatgcaaaaatcctcagtaaaatactggcaaaccgaataagcacttcaaaaagcttatccaccatgatcaagtgggcttcatccctgggatgcaaggctggttcagcatacgcaaatcaataaacgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagaactatctatgacaaacccacagccaatatcatactgaatgggcaaaaactggaagcattcccttgaaaactggcacaagacagggatgccctctctcaccactcctattcaacatagtgttggaagttctggccagggcattcaggcaggagaaggaaataaagggtattcaagtaggaaaagaggaagtcaaattgtccctgtttgcagatgacatgattgtatatctagaaaaccccatcgtctcagcccaaaatctccttaagctgataagcaatttcagcaaagtctcaggatacaaaatcaatgtgcaaaaatcacaagcattcttatataccaataacagacaaacagagagccaaatcatgactgaactcccatttacaactgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatattgtgaaaatggccatactgcccaaggtaatttatagattcaatgccatccccatcaagctaccaatgactttcttcatagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgctccatatctacaactatctgatctttgacaaacctgagaaaaacaagcaatggggaaaggattccctatttaatatatggtgctgggaaaactggctagccatatgtagaaagctgaaactggatcccttccttacaccttatacaaaaattaattcaagatggattaaagacttaaatgttagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagactaccatcagcgtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatacgaacagacacttctcaaaagaagacatttatgcagccaaaagacacatgacaaaatgctcatcatcactggctgttagagaaatgcaaatcaaaaccacaatgagataccatctcacaccagttagaatggctatcattaaaaagtcaggaaacaacaggtgttggagaggatgtggagaaataggaacacttttacactgttggtgggactgtaaactagttcaaccattgtggaagtcagtgtggcgattccttggggatctagaactagaaataccatttgacccagccatcctattactgggtatatacccaaaggattataaaacatgctgctataaagacacatgcacacgtatgtttactgtggcactattcacaatagcaaagacttggaaccaacctaaatgtccagcaatgatagactggattaagaaaatgtggcacatatacaccacggaacactatgcagccataaaaaaggatgagttcatgtcctttgtagggacatggaagaagctggaaaccatcattctgagcaaactatcgcaaggagaaaaaaccaaacgccgcaagttctcactcataggtgggaattgaacaatgagaacacatggacacaggaaggggaacatcacacactggagcctgttgtggggtgcggggacgggggaggaatagcattaggagatatacctaatgttaaatgactagttaatgggtgcagcacaccaacatggcacatgtatacatatgtaacaaacctgcacgttgtgcacatgtaccctaaaacttacagtataataataaaaaaaaagaaatgcaaatcaaaaccacgatgagatatcatctcacaccaggcagaatgactattattagaaagccaaaaaataacagatgctggtgaggttgtggagaaaaagggatgctcatacactgttgatgggagtataaattagttcaggcattgtggaagacagtgtggcaactcctcaaagacctaatgacagaaataccatttgacctggcaatcccattactgggtatatacccaaaggaatagaaatcattatgttataaagacacatgcacacatatattcattgcagctctattcacaatagcaaagatgtgaaatcaatctaaatgcccatcaatgatagactagataaagaaaatgtgataaatatacaccatagaatactatgcagccatgaaaaagaacaagatcatgtcctttgcagagatggatggagctggatgccattattcttagcaaactaacatggaaatagaaaaacaaataccacatgttctcacttgtatgtggtagctaaattatgagaacatacacacacatagaggggaacaacacacaacacaacaacaacacacacctttcagagggtggagggtgagaggagggggaggatcaggaaaaactactaatgggtattaggattaatacttgggtgatgaaataatctgtaaaacaaacttttgtgacacaagtttacctatataagaaatctgcacgttacccctgaacttaaaagtgaaaaaataacgaactgcattccattagaactagccgtgaaataaaaagatatttccaagaaagcttcaggaatagacttcccaagaaattttataaaaccagaattgattttcacatgtctgggatatttagatgtagccttgcctcaaagaaacccttcgaggttttttccagccgtatgattccatgacaggatgctggggctacagtaatccttggttgatccaagaacatagagagcctagcatctgcctgccatgtagaagcactgcacaaaggtctcatgtatatgattcattacatgtgcgtaaatggaatacaattgtctatttttaggccaacttgtggtatctccataattttcagattttccattattaaaaaaaaaaaaagagagagattcgaccgggcgcggtggctcacgcctgtaatcccagcactttgggaggccgaggcgggcggatcatgaggtcaggagatcgagaccatcctggctaacacagtgaaacctcatctctactaaaaatacaaaacattagccaggcatggtggcgggcgcctgtagtcccagctacttgggaggccgaggcaggagaatagcatgaacccgggaggcagagtttgcagtgagccgagatcgcaccattgcactccagcctgggtgacagagtgagactctgtctcaaaaaaaaaaaaaaaaaaaaaaaaaaagattcatccttaagtcatttaaataaaatgatggaagaatgatttctatgtaagtgatttaaaagcacaggcacttgatccaaatccttctgggatacaaagcatcccaaagtacataacacaatttcttgccttattaagctacagcttcattacacaatttaacctcttttagatgactcacagtcatcatctataaaatttaattcaacacacatttgaggaacatccactatttcagcacaataccaggtttgccagtctatgcccatgtctaacaataacgcaagagattgtggttatgtcaaagtgaggttgaaagtcagtgctgggagtactggggcaggatggaactgggatcccagggaaggcaggtaagcatgaggacaaagagctcagcccgctgtgggttgcagatcccatcttcctttgctaacctgcgtgaccctggccagattgcagagtcttcatttcagtatcactgagtgaagataacaatcataacacctcctgcgtaaggtagtcaccagaattaactgatgcaaaacagtatttttaaaaatgtgagtcataggaggaatttaatggaacatgacaatcactttaaaaacaaaatgaaatagaatagaaaaaaagtcaaatggaacagaaaatatcggagggcatcacgtgtagtaaatgtaagtttgtggtgtgcgagtactttcgtggcgtgattataacttatattttctatcgtgggtcaccatagggcaagttcaaaaaccataggtataaagcttttggcactcggtgcctaatgtgtagccagtgataaaaagtggtgaaataaaaatacagcatttaagttgagctttaaacaataaacatttttaccaaagaggatggaatggaaaaggtaagaaaaacccaatacgtgtacacacacacacacacacacacatacacacacgtgcacaaatgcagacacatatgagacatggtattacttagatattggatggaagaaggtttttagaatatgaaactagacaggagatgcagctggattgtggaaatctatctaggtcatattgagaattttgaatgtctttaggtaaaaactgcgaagtcatccaataaatttgcactaggaaataacatgctcagattcagaattggaaaaaggaattgtgacagggatgtggacaacagactgggagttgagcctggcagtgggaaggcttctgacttggttttgattctccaggggaggacctgaagcaaggcaatggcattgggtgtgaaaggaaggagattaagaagacattgcattgggaggccgaggcaggccgatcacttgaggtcagaagtttgagagcagcctggccaacatggtgaaaaccccatctccactaaaaccacagaaattagcctggtggggtggcgggtgcctgtaatcccagctactcaggaggctgaggcaggagaatcgtttgaacctgggaggtggaggttgcagtgagccgagattgcgccactgcactatagcctggcgacagagtgaaactccgtctcaaaacaaacaaacaacaaaaaagacattgcagagagctcttgtgacatgatgtcactttgctcatttatttcctctgatcatattaccctttcctgcctctgattcatcaggtaaaattcttctcttcctgcaagccagggctagctatgtgttccaagcaaccatctctggccgtatgtttgagtgacacccagtccgcgctcctgcactgtgctgtgcacatcattgctgtgtcctctgtcacatcacacagaagggtgacattgtctagtgtttcctgccttccctggaacttctgggtatgggtttggagcgtacgtcatggtccctttgtggttaagacatggaccagaatcttatgacagattctggctcgtgatttgtgcttggagcgtttacctgcctatgtcagcgcctcagagatttctttctctttgtcatgaaacctgcctgggtccttcctggagtgaagatagcatggcatgtactaccacatactcacaatgagcatgatcgtgaaagaaaaataaaaccattggttgttgtatggttgttgtaaatcactgaggtttcaggcctgtttgtgatgccccctaactcagcatctcttgattgatgtgattcagaacctggctcagagcttggtgtaagagtagtgctctatgtttatttgtggtaaaaatgaataaatgattaggagaggaactataggtagcttgaaggcttctggtcagaaggcagcagattttgttagatcgtaagctaaatcagaacacaggaaaagagggagacacaagtataaatgtgtttgtgggcacattgaatgcgaagtactggagaggtcttcctgagtacgcagatggtggtaagctggaaatataggactgacggttctctaagattgtcaggatagagataaaaaatgcgaactctttaatttcagatgatagttacattataagaacagattcaatgatccacagagatagtgaagaatattaagagataaaggaagaatattgggaaatgcctacatttaagggtgggaagcagagggacaagaagcaacaaagaataaaaaacatgataatggaagctaagagaaggaggattttaaaagcaaattgctatctagtagcgtcactatatgctacagtgacatgaaatagggagggtactgggagggaggaacgacgttttaatacagccaggaggtccgtgttccgtgtgagagaggaagaatgaacacagcgatgagtatcattgtagatacagatgagcacgttagatgctgctttccagattccacgttataccacttttccactccttgagattcctgcacatttctggttctcggaagtcccctttcgctctcagcctgactatggctttatttgatgcagtctgtggctgattgggaggcaaacacacacctgttgcctggggtgggaagctgtctggacctggtgagttactttgcctcccagaagacttgtttaattctaagttatgggctacaatgtggagaacttaattgcccaggtcttctgggtaagaagagtagtggtgtattctcactgattaactcagcaacatttattgagcacctactatgtacaggaactgaataacattatcatctgaagctggaataaccaatgtgaatcacagctcagagatattttatgccttctgatttttagttttcattaatgagaagtctgtgcttcctaattttacatttctaagctccgcaaatgagattagcattgtgaaacagacaatgtctatatcataatgcttatttaatgtgtatatagtaaaagcagtctgtttgtgaaagtttttcagactgcttttatgtagacgggagcgttggggaggaaatgaagcttggctgttttcttcctgggaccttaaaagggttatctcacgtctttggattttcattgcttataatagattgtttgatcattcaaaccactatatattaaaattaatagccagaatccacaaattatgtggatgaggctctgaatcaaatgacttttgagattttgcagtttgaatctctgattggggagtttaatatctcattgcactgttggacccccgagggaaagttcatgttcagtccacatcatctttagacaacctgtttgtagattcattctcagttaccctaacttgtcatctggccacatgcaagtttcaaattctaatgtctttttctaagctaaactgagagagcaccatgaaataaatgcctatcagcagacattatatgtcacatattagagaaaaaagcttgtctattttaacagggttctttcccaagaaggggagatgaatttgggatcttgagagaaaatgacatcagcgaggaggttagctgagggactcttataaaagggaccaaattacaaggcatattgtgtcctgatttatccccctatgttctacatttaactatgaaatcatttcaaagaaaaaaaaattcagatttatgagcaaggaaaatatctagagctcatactgtcctctggtggtcattcgcacacatagccagaaatgcaaatgccttggaaaacttgacagcatctagtttaccgactgaaagtcaaattgcagaaactgatgaaaacaaaacaaaacaaaaaaacaccctctttcctgtactttaaagtttcttgatcatttcatatttaaaacagaataatggatactatttacaagtattcacctctgaagagaaataattgtctctgagcttgactctcactgatactatttgatgtaaaaaataggtctcgtgctcttaaatgatggttgagatagatagacaggaaggtggatatggagagggaactgtttttagttcacttcacttcaattaagatgctctggggttctgggacctccttgtaacactttctaggtattatctcctggaagaacacaggcacctgcccatcatatttctatgtctctagtctttttaatatggtcaaaaggcaacacagagataccctgataaaaatctcagctgttatttcccacctttttctggtgggtttgctctcattactgtcttttttttttttttttttttttttttgagacagagtcttgctctgttgcccaggctggagtgcagtggtgacattttggctcacggcaacctccacctcccaggttcaagagtttctcctgcctcagctcctcccaagtacctgagattacaggcatgtaccaccacacctggctaatttttgtattttttgtagaggcggagtttcatacgttggccaggctggtctcaaactcctggcctcaagtgatcctcctgccttggcttcccaaagtgctgggattacaggcgtgagccaccgtgccttgctggccctcattactgtcccttttgagagtgtgttgttaagatcctgggcaggtcaaatcccattgttctgtgggtgaagagacaggagaaatcctggggaaatgcgtttctaccccatctaacaacacctgtgtgactttgttttcaggataggatgttttttcttccttttctattgtatgtaattcttaggccaggaggacagagccaaatacagcctgtatcatccacaaataggggctttctcagtaagcatcagtcactaaggactcatttcaagtaagccaggtagggatttttagtgcagagataaagataagatgattgagaagacaaaacgagaggaagctgctggtctttctataccctgctaggtgctttctagcctgttagagtcaaaagagcaaccgtgaatcccatagcaaagagatcaatgaatgaatgagtgaatactaatacagatgcaattcaagttctagtggaaaatgagtatactttatttcagcaataatttttgtctctctttggtgaatacgggacatgtcagtgataagcagaaaagcagaagccaccctgggcattgagggcacaatggctcagctttttttcagtgtctacgctgctctccatctctgggctttgatagtaggattcagtaagtgaggattaacagcatattgaaaaccacataagaagcccagaaaaatgttgtggagtctaactctgactatttacgtttacatattgacttcaagggcagagtactgccatgaatgcataagcagtagagaacacaccttgctttttcagcaacagacggaacttcatgggccaagcaagcccacacactctcacacactcactgttggggtacaccaggcctcaggggcacctgtggactctgagcttgggcaaacatatcaccttgattaaaagattaatccataaatttgtttgggaatatttttcagccctaacaaggaaggagattccatcgcatgctacaacatggatgaaccttgaggatatcatgtcaagtgaaacgagctggtcactaaatgacaaatgctatatcattccacatgcatgaggtccctagaggagtcaaatccagagacagaaagtagaatggtgggtgccatgggctggtgggagggaggatagggaattcgtgtttaatggggacagagtttcggttttgtagagttctggagatggatggtggtgatggcttcacaacaacgtgaaggtatgtaatactgatgaactcaataatcaaagtggtcaagagggtaagttttacgttatgtgtattttaccagaaaggaaacaaaaccagtgtgtatattcactcaacaaacgcttagtgaatgactacatgtgtcaagttctatgctgggagctggagatacaaagatggaagagacatggcacctgctgcagaaaatgtcataatgtttccatgaagacatcgtcaattttggtgggtcattttaatgttttcttttctttaaaatttccctttttgatatgttttggtgtggtctcagaagcagtctaactttataatgattattcagcaggaataatatgaacgataacaaaaaccacactttgaaatagtaaataacttttagttccttcacaatgaaccaggctgactgctgtaactgtaagggtaatagatcttcattaaagtccctcatttctagcacaatagggttttgcctgctattcttttccctgtgagagatggaggagggaaagaagggagggatagggtgggagggaaggaaggagggagggaaggagggagggagggagaagggagggagggaaggcgtgaagtgcttatcatgatgagtccaacagtaaaatcaataggtgttgtccactgactatcaattaaggcacaatcaaggcctctgggttttgattttgatcaggctgctggcagtttagtgggaactcaccaaataaacaataattccagacaattgtcccccttgtcatgattcaggagcgtattttcaaatgaggtgtaaatgaggactttgttttgtatgtggagacagcaggggcaaaacaaaaccactggaaagacccaggtaggtgggaaacaaaggaacgaaactgtccagtgcgagcacctgcagctcgtccctggcagacgcttgaaaggcacttggttatttaccaacttactgtgggataggggtgggagcagaatacagtgtactttcggatgatgccgttcagcttgagagggggaagccaggacacaaagaccatggaggctgaggccgccgctgccttcacacccgcgggaggacctggaactggaagagccgtgtgtttagtcacaaggtggggcctcaacttgggcttgcggacccacgcttcccaacatgaccccactccgcacttactgttcagctctttcaggatgagcgttatgggttccgctgtgtccccccaaatgcatatgttgaagtcctaacccccaggaccacagaatgacactgtaattggaggtagggtctttacagaggtaatcaagttaaaatgagtttgttagggtggtccctaatccagtacttctggtgtccttataaaaagggccagtttggacacagagacagacatgtatagagggaagatgatgtgaagacacagggagaagagggcatctataagccaaggagagaagcccaggacagatgcttgtctcaaagctcttaaagagaaccagccctgcagacaccttgattttggacttctggcctccagaactcagagacagcaaataaattcctaatgttggagtctgtggtcctttgtagctctaggacctaatacagtcagttctagtccctcttgtcctggggagtcttcccaacccatttcagcccctggcaacttcctgcctctggataactggagaattaacttctggatcagtctcatttctgctgcagtttttggctttgaatgtactggggatgaaccttttggatcctgaatttgagaagcatgagggtgaactacctcagccatcagagaccccaccctccctcaccctagtcattttgtaatggcaccactttgggctcaggagaggtatggaaatattgttgatgaatagggattattgggtcaaagattcacagtatccatgtaagacaaactctcctctgtaaaccagctaagaaggcagaacatggtggcagcaatactaagcatgatttgggagtgagattgaaggcatgtcccactcctcttgttcttttattttccaggttgaagaggtgagggcgggtgagatggccaagacaagaagatgccaaaatgtcaaaggtgccagtgaggaaggcatcagagctcttgctttgtttctcattaacctcactgtccatatggagggcaaccacattgatggagacattgaaattcaaaccaatagaagtcccttgcaagcccctggagaaatctgtgagtcttttactgctttgatggcaatgcaactgctcagtaaattgttttggagttgaatgtgcttctcataatcgtcaccttgactcttctaagtctgcataacaaaaccaagagctctggtgagaactaacttgggttggacatagtcaccatttgaaaatataaaatcttggtaatccatttttggcaagtcttgctaacagtggaaggtctagaaaaggtaacacacataaatgatagatcctgggttaaaaaatcccttgagaacaaacctctatcaggtgagggtaatgtctaagacatccacaacctagttcagagctgccagggttcctcctgaacaacaagggcagagtgaacgtttcctggggattttaatcctagtagacaccccagcttagccaacactctcagtcctttccataaagcccctggttggtgttcaccacagtgaacattcttgctggacagcttctctttaggaggccaagtagtttagcaccaaccagttgaatggctgctgaagaggagtcagttgtatttgtttccaacctgtttgtgacaattgtacgtgtcatgggtagtactgtaagttaattaattacgtaaaccaatgaaattcaagtgcaagagaaagctgtttctatgacagttaatgggactactttggaaagccttccttagaggtaagttagaaaagaaattaaaaagagaaagaaatgaaggagggaagaacaaaaggaatgaaggagggaaggaaggaagaaaggaaagagggaagaaaaaagaaaggaaggaaggaaggagggaaggaagaagggaagacaaaaggaaagaaggataaaaaagaaaagaaagaagaaaagaaggaaagaagaaaggaaagaaagaagaaggccgatctatgtttggtcaggaccactgagaagaatgggacatgtggatttgtcccaatttgcaaacagatcgttggtaaatggtcacatgctcttacttgagacaccagttgaaaaatgcagatgctacacattaaatgcagttcatggagtaaaagatggcacagagctccaatcttttcacccaaaacttcaagaagtgatcctaagtcatgtgattagagaatgattagggaataaatacatatttatatgttttaagttaaaatgcaacatttcaggtacttcctggccactgcaaagtttggtgattccttgttttaagtgatgatttccgtgagcatgcctgtgtcacagccgatcaagggacttttactgcaccatctaaactcgcagttggctcctcctgcatggatttatgatctatcttacacagtctttccttgtatggttactagaactttgtacaataaaataacaacatagataagttgaagaacacggcattttggaaggttttctggatgactgagctaatcttttcagagctagaacttaacattttagttctggtttggacaacatcataaagcttaaaggtgtgggccctggagcctcactgctggtttcatgcggctctagcacttagttccacgtcctggacaagctgattaacttctctaataatctttagttccctcatttataaatctacaataataactgtgctggcttatgtttttactgttagaattataagagataattcatgtaaatcatttatttattgttctctgtacagtaagcaccaaataagttctagctatcatctctaataaccatccttatgtccttggattatatgtcactaaatgatactagcctttactttgtgactcagtggtgaatgacaaacaccagacactgagagttgcagaagacagagatggcataggatggagtaaaaaacggtatatgtctgtctgggacatattttcttgaaacattcttagtgaccacattccattttggtaatctgagtttttcttatgaaggtcaaaacaaacttgggaagttttcatgaattcctgggcatcatagagaggagttctgcatttaagtttaattgattgcagtaaagaatgtggccttcagagaatcctctcttctacattcctccaatgcacctggacatcccttctgagctgcagatgcttctgtgtctcatgtgtccaattggctgagatgtttcacacgggcaccttagaccgacatagtcacaacagcactcaccatcttctatccaaacctgtgcttctcttgccccatctcaggaaatggccccatcatcttctcagttgcaagaaccaggacctggaattctcttcctgctgtcacttgatgggccctttggaggtccacatggacaggacaggtcagcagttgggctctccccctgatctgatggtgctccccaacactgagctctgtttcagttccctgaacgtggtttgcttctcccaccccgggcccttgggatgccatgatccagggccttgggatgcctctgtctggagtttttcccaccctctgccttcttcctggcaactcttactcatctctcaggttctagcacacgtcatttcctccaggaagtcttccctgatcaccagcttaggtcaggtcagggctcccatgtctctgttgagactcttcttcatcattgcacttgacacagtccactcaggggtgatctatcaacgtctgtctcccccactagcttgcaaaccccaccatgcccatcctgtttctctgcatctttagttcctgggccagtatctggaacatactagatcctcaatacagattttccaagagtggaaaaatgatttcattcgtgtctgtgtggtaggcaggattctacaatgggtccccaagatccttaccttctagtgtatgtgcctgggtgattccttccccttgaatgggtgtggcatctgttactatgatggacagattcctcccatgggcaggttgtgccatgtggcaaaggtgaagggcttgttcaggtatcattgaggttctaatcacttgactttcagttaatgaaaaggaaagtttcctgggtgggctgggtttaatcagatgcgccccttagaagaggagatggaggtcagagacaaaagaggtcagagggattggaagccatgtgagactttcctattggtcctgaagaaggaagctaccatgctgtagggggtgtgacagggagtaacaggcagcctctggaagctggtgactccagcctcataaccaaacaaaaaaaaaaaaaaaaaaagatcccatatcctgtgagcctgggagaccttgacctcagatgagggcacaggcccagctcacaccgtgattcatctgtcggaccctcagcaggggactcagctcaaccagacctggatgcctgacccttagaaacgatgagataagacatttgtattgttttaacgtgttaaggttgtagcaatctgttccacagcatagaaaataaatacaagtgggtaagccctcctgtaacataccttaatgtaaaaataccacaatcatttttctgaaacagtattgccttgttttgaagtatgaatatcggacaaaagtctgactaaacacccacacagacaccgcagtcagcttcattttttttcaccatcatttttctggtcttagtaaacagccacaggcaggtgtgtgtgtgacttgtgcatgcacaaacatgcatgtacatatgtggtacaccatggtagccagatccttctgaacccacaacttttcagtggcttttcctgagccatgccgtgccgtgcagatgctacgatcctggagggacatgtcacattcacagctgtcatcccaccaagcatgcacatatgtcccttttctcttcccatgtccataagactctagtatttttggcctttcctctcactagagcaagagtgttcattctttaaatgtttgactgatcctttaaccaaatcatcatgtggaaacccagcacataacacaagtggaagtggggtggctcttgaagctggggtcagggagagaatggagtctcccactgggcctcttgcttaccactgggcactgctgaggcccacctagtttgaggtaagaacctagtttgggatccactgcagtggagggagtgtggaaagccacatggtagaatctcttctaggacatcttgtctgtcgtgttgctggtatacctgccactgcacatggcacactaccataggctatagagcactggaatcttgagcagtgtggattggcagtacttcccagtgtctactgaggggcagcaccactggtggctatgcaaacatagcatgcaatctaccccctttcaggtctactgaggtgtggtcacatagtcaccccagcacacgtcacaggcacacactatccacaccttcacaagtatgtatggctcaaagtatgggtggtcagaagattcagaggtatccagatgtcagcttatttttttgcttcctcttagctctactttcagatctcctcccaatgagattgctaattgatggtggggagggagtagagatcacatattacacctgctgctggccctctcacatgtaccttcagagttaggtgcattagtgatgtgttcagtaaatatttgaacttaactatctctattgatacatatgcaaagtttactcttgtgtaaagggatcaaggctgaaactagcttttgccttcagagtgaaaacagcaattggaagattaatagattgcattttgtttgtgttctctttccttacggcttgactcgtattatagtattggcaaataaaatggcatcaggatttcacaactgtttttagaagtcaggtttagttgctgttgtgctcaaaaacagaaaagccagatcaccaagtcgtccttcgtgtttctgcagcaataatggggtacaagttctcactgatagagcagtcctggaaagagaacgtgaactgtgagcagtagtcacagaccccaaaaaatatgtccatgcacctgagtctatatttatggataaaagatgatatccatggccctgagactctgactacaggcatgagaatatgtccatgtacctgagactctatttacggatgagagatgatatccatggccctgaggctccgaccacagacatgagaatatgtccatgcaccggagactatagttatggataagagactatgtccatggccctgagattatgaccacagacatgagaatgtgtccatggaactgtgaatatgactatgagcccaagaatctttagatagtggtagagaaactacctgtagagaacaagcacagacttgtcctctaaacaaatatttctattgcaaataatcccttgcaaaagtacaattttgcctttattagggttaagtttctctttttagtatgaccagtgacctaataacacagtttaagcctccaggctccctagattaggaagactggtacaggacgtgtgtctggcatagacaactgaatcggatgctcgctgttaatgtagctatctttcttcgcttgcaagaacgttgataaacgctgaaacttcaacctgagcctaaaatagtatcttattgagaaagaactgagcaaatgttggtaattattattttactggaaatctatctgtatttttacacaatttaattgaaattgtaagtgtaatccaaacttcaaaattacaaagctttctcattgaagtataaatacgatctgtaatcaatttgactgggcatttgttctctgaattgtcctttgtcccttcttccaatcagataaataaaatagcatttaattctgtaaactgctgaaatgcctaattatattaggtattgagtctacaaaagtggttgacacaattcttcaccgtttctaaattattgaatttttcatgtgaacctgggagatgaagtgatattattctagttcttctcttcttccacccaatcttcactccacctcttttttctttttgagacagagtctcgatccgtcacccaggctggagtgcagttgcacgatctcagctcactgcagcctctgccacctgggttcaagtgattctcctgcctcagcctcccgagtagctgggattagaggtgcccaccaccacacctggctaattttgcatttttagtagagacagggtttcaccatgttggccaggctggtctcgaactcctggcctcaagcgatccaccactccacttctttttgaaaatgcagacttatcctaaagaaatattgacactcagttctgcatagtccttgtcccataccaccagcaaaagtgggattcatggcatcttccttggggtaactggggtacccaaggcagggttttcgatagtcaatcccagctccatacactatcagcactggagacaaaagcaaagcataattgattgacaaattagaccttgggccttggggtcaagttttgagacagaactccatgattcttaaaactccaatattaattaaaaattgatctaaaattgtgagttaataaggatctgtgaagagccttcccttcttattggatttctgtacattcttccaaaaatgcagatgcaaaacattttgtggatgatcaatttgctctttaaataataattccagtgacatttgcattattgcctagcaatgtaaaaaggagtatttcacccctactctgaaggagtggagagcaaataatcaaatattgagggtcaggaagcatcccactctgtggcaagcaggtgttttcagacaccacttcagctctcatacactggttctgtgcagtctgatggctacagcagattgtccctgaggacaatccagttcagagacacttaggtaaggtgcccaaagacccacgggcagcaggtgacagagccagcatttgcacagctgtttgtctgttacatttttaaaaaattaacttatggctgccttcactcaggacttagctttctagatatctctattgatgtgtgacttcctaatggcattacatttgaaccttagattccctaaataatccaatttcttagagcagaactggctgacacctgcacattccctggaaggactacctgtgcattttagaaaaaaactaaagcaaatgaggattagtttgggtgtagacattacaatgtgagaagggctacagaggcagcaaaaacaccaggtgagagtggatgcctggggctgctcggaggagcaaggcctggcttgccaaggtgagagcagagagtgacgtggaagatggcaggctcagaataacagggagtcattgtcaggggcagaaaggctgaagagaagagcgtatcatggcccctgagcaggtgttctttgcttccatcagagcagatatgggatggaataacagcatttttgatactctagtagtgggggagatagcatagacatcaaacctgcccatacacaggaggtgaccagcaatggccaacagctttcccgcccctgtactgcttggggaacagagtcccggcaagaagacaaaagttgcagagacaatccagcacagcatttagatctgctaatgtctcatctcaatgtatacttctgtgctggaatattttgggaaggttctatgtgggcatcaatttgacatcagttgctccttcctttattaaggtggaggctacttttctcactaccacggtagtatttatcagaacttatctgttccttaaacaggcttggccaaggcccctcagagtttcccttaaaataatacagaacctttgttgtatggtttttgtacgtttgggtaatagtcacaacccaatccaaattgtaaggaacagcaagaattattgttgtagaacaaaatgagcagcaatttaaatttttactaaatcaccatgaattcttgcaagaattaaaaaaaattaacatgaagttctcaaattaaggacttattctaaagtgattcagctggcaaagaataatagaacttcagtctgtacataattttcaagaagtggaaggatggatttaatcagagtttacactaatagctgaatagctactaaaattattctaacaagatacaaaacatgtatgacaagtattacagctctaggataaaatgagtttctatttacaataatacttggccaaaaaaaacaaaaaacaaaaaaaaagaaaagaaagaagaaaaaatatagaggaagaagaagcaatggattagacacatcaagcaaaggcaagagaggaagttaatggtctgaattgcactgggatattttgggagggcagcaaaggtttgcactgagaatagcctgatgaactgcagggtaaaggcaagtgagctctctgtgacccagcccttccagcaactgctgggacccaccgcccacccgtctctcaccatcctctttggtccgggtgaagatctgctcactcctgaccccgtctcctgcgcgggtgaaggccagcacctggatgctgtagttggtgtacttttccagcccgtccagctccagtgaaggctgtgtggtggtgatgtttttaatctcacccagctctggaggacaagaacaagaaaacaaaatcccacttctgagcccatttctgctcgtttttccgcactgtccccactgactgtccctgtgccatgccatcacccgtccagccatcatctggacacgagaattctcaaagggactgtgcacagtcatcctgtgagctcatggtgtcacgtggccctttggaaaagaacattcacaccaaactgctccagaacacaaggcagaacgttggtctggaaaacgaagtaattcgctccaagttaagtgttatcaacccaaggccagcaccagggctgccactcacccttcagcaggtgctaatgagcaatgtcccctgcacccctagcagcacacttagggcgacacacacacgctgcacacttggcagccccactgccgactattcattaggaagcttctgcaagctgaggggttttattgttattttaaacaagctctactttaacatacatgtatttttaagtacctaacttcatcccaaatatctgatctaccctcttcagcaagtttcaagtctataagacagtgtctttaactatagtcaccactttgtacattagatctccagaacttattcatcttgcataactgaaactttgtatcatttgggggtggaggaagaaaatggcaactatgtgagatggtggacccgctgttaatttgcttgattgtggcgagcatttcacattggatacatacatcaaaacaagctgcatgtctgaaatatatgcaatttttatttgtcaactataccttaataaagctgaaaagataacatatttaaataagaaaaaaatacacctgagctaaactgagtggctcagccaacccctctttttacctggagtgaactcctctcagcttcaatcctgaagtgacatgcccatgtgtcagaaacttggtgtcagctaaaaatgcttcactttcaggagtgggatcaactaataacattcacagatggaacactatgcgctctcaactccagcatatgatacacggcaatttgagaaaacttacgaatgttgtgctaagtacttccttggtgtttggctgatgggttttgaaatgagtcgccttcagagcatgagaagggcctgagaactgttcccctaggggaaggggctgtcagcgacacattggtacccagagcaggccggttaccccaagagaccagcaggtctggggagttccttgttgaacagctctgatttggcagacctgctcgtcaactgacaatccagctgcttgtcaatccctctcactctccctggcctccatatagggagtggatgtgatatgcatgcctgcctaggtgccagcgctatgctattctaagtacagatagtaacttatacaaccagcagagttattcaattacttttgcaacccattcattttacagacaaggaagtcgagggacagagaggatcaaggagcccagcacagtggctgagggcacaggccgcggatctcagctgctctcctcagtcgctctgggaaaaagcagaaaatgggctgaaaatggaggcacccacgagccgtcgtgtcggccagattaaacgggcttttgctttttgcctgtcttggttttccttcctgctcattgtttttcttttctcttgtgtgtccaggatattgcacagaagttcacaaatgaatagccacgtattttgtgtgtccaggatattgcatggaggttcacaaatgaatagccatgtattttgtgattacgatgactgtggaacatcttttgttcatcttttttttgtcaccaaaaagatcaatgtggaacggatacagcattaaaggagcatggcaaatactgcatgggatggctgaggcctgtccctcacatgccagagagcccctgtgccttctaggagttgcaagaagaggggtaaaggggctccatgtggctcccacagtccaggccccagtgggagccaaaggcctgggagcaccagaagcagacagttctgtaggctggggctttgctggggagggagcagggcgaggatggcccaaagacaggcctttggactcctgtcttctagggaggccagcagggtgccagctgttaaaggtcacaatttggaaatctcaacggagggcttacgaaaatgaggagactgtgtgagcatgtgtggtcaccaggtagtcaaaatatcaatacttggttgtcccagatggattggaaattctcatctctgaaggacgggtctttccatattcaattatattccttttcctgaatatatttaacataagtcttttggattaggataaaaacccaaatgtaaccagacatgatggctcatgcctgtggtcccagcctcccaagtagctcaaggtgagaggatcggtggagcccaggaactggaggctgcagtgagctgtgattgtgccactgcactccagcctgaaggatagagccagaccctgtctttaaacaaactaattaaaaactcatatgctaatggacaaactttaaatatagaactcattaagatcttttcagatttagaaacttcactgtcaaagatcacacacgtacctccctacagatatatacacacgcaatcaataaaaatacagctgaggggaggggctgatcagggcagggtgctggtagctggttatgagactctgatgaaggtctttttttcccaagagtgcagggtgtccacctcacagaaaaagtaggatcatttcacaatataggagaaagctgtgaccctccggcaaatacttgaatcagaatgcaactcttgaatcagacagaatgaggaagaggagcctggtggggagggagaaggacaacctggcctctctgatcttcttaaagaaagcaaacacttggcccggtgcagtggctcatgcctgtaatcccagcacttcgggaggccaaggcgggtggatcacgaggtcaagacatcgagaccatcctggctaacacggtgaaaccccatctctactaaaaatacaaaaaattagcctggcgtggtggtgggcacctgtagtcccaggtactcggggaggctgaggcaagagaacggcgtgaacctgggaggtggagcttgcagtgagtcgagatcgcaccactgcactccagcctgggcgacagagcgagactctgtctcaaggaaaaaaaaaaaaaaaaaaaagcaaacacttaaaacaaaatgattaaaaatgctaatggttaatatactaattagaattaacattggggggggggttcaagttattttgattaactaatttatcatgaaccatgaagacaaaggcagtcaaaatcccaattttaagatttctaaaactacctgagccacagttggctctatctgctagaacgcctcataggctgtgaaggaaggctattttcctgatgacagatactaggtgactagcagatatggaagaaataaaaagcaaagaatgaaaaagaagaaagccagatacaaaactgagtgtttagtttgccattctttttaacgctttttctttttaaacatgagtttctacagtctagctttcatgcctctgtagggctgtttaatacacacacacacacacacacacacacacacacacacacacacacacacacattaactgaagtgtattgttcagttgaggtcatgagtgaaataaaattaaaaaaatatataaaataaatttagaaatcagattttttctattaaaaattttgttttaaacaaaatagttttgtgtatttatatcttgcctcatcctcagagggttttaaggcagaaaacaataggtgcgggaatagcttctgaagcaagcctcagctgcccacacactccagttggcacctaattgttgcttcctttcagaatgtaccattttttccatgaagaaagatggatgagatggaagttagcaaaaattcagaggaaaatggtaacttttcaaaggatacaactttcctagcaatctcaaataaattgtttctttcaggccttaaccatgatttaactttctgaccatgaaaaaaaaatcagaaaattcatcaaaatattgtttatttaaccttccctatcaaatatactaaccagttttatttcatctgaccacattaacaacagaattctttcttagacgtattttggaaagtattcgggctattgctaattacagtggtagtaacaatatttgcccctctcagcctgtgtgaatgtgtggggggtgtgtgtggtgtttgtggtatgcgatgtgcatggtgtgtgtgtacctgtgtgcgtggtgtgtgtgtatggtgtatgtgtgtgctgtgtgtatgaggtatatgttgtgagtagcatggggtgtgttacatgtgttgtgtgatgtgtggtgtggtgagtggtgtatgtggggggtgcgtgtggggtgtgcgtggtgtggtgtgtgtgtatgtgtggtgtagtgtgtggtgtattgggggtgtgtgtggtgtgtgtgtgtgcatatgtatgcggagtgtgtgtggtgtatgtggggtttgtgtatgtgtggtgtgtgacatatacggggtgtgtgtggtgtggtatgtggtgtaggtgaggtgtgtgtggtgagtgtgtggtgtatgtggggtacgtgtgtgtggggggtgtgtgtggtgtgatatgtggtgtatgtgtggtgtggtgtgtggtgtatgtgtggtgtgtgtggtgtgtatgtatgtggtgtgcagtatatgtgggctgtatgtgtggcatagtgtgcagtgtatggggggtatgtgtatgtgtggtatgtgtggtgtgtgtacgtgtggtgtggtgtgtggtgtatgtggggtgtatgtgtggtgtgtgtgcatgtatatgtggggtgtgtgtggtgtgtaagtgtggtgtgtgtggtgtgtatgtgtggtgtggtacatggtgtatatggggtgtgtgtggtgtggtgtgtggtgtatgtgagatgtgcctggggttatggtgtgtggtgtatgtgtggtgtgtgtgtagtgtgtgtgtagtgtgtgttgtgtgtgtgtgtatgtatgtgtggtgtgtgtatgcatgagtatgtgggatgtgtggtgtggtgtgtggtgtgtgtatgtgtggtgtgtacatgtggtgtggtacatggtgtatgtggggtgtgtgtggtgtggtatgtggaccctgaaaacctgagacaggtctcagttaatttagaaagtttattttgcgaaggttgaggacgtacccacaacacagcttcaggaggtcctgacaacacgtgcccagggtggtcggggcacagtttggttttatacattttagggagacgtgagacatcaatcaatataggtaagaagtatattggttcggtctggaaggcaggacaacctgaagcaaaggcaagaagacaggaagcggggaggggacttacaggtcacaggtaggtgagaggggaagggttgcgttcttctgagtttctgatcagcctttccaaaggaggccatcaaatatgcatctatctcagtgagcagaggggtgactttgaatagaatgggaggcaggttggccctgagcagtttccagcttgacttttccttagtgattttgggggccaaaaagatattttcctttcataggtgtatgtggtgtttgtgtacgtgtggtgtggtatgtggtgtatatggagtgtgtgtcatgtggtgggtgatgtacatgcagtttgtgtatgtgtatgaggggtgtgtgtcatgtggcgtgtggtatatgagggatgtgtgtgtggtgtgatatgtggtgtatgtgtggtgtgtgtgtgtggtatgcgtggtgtggtatgtgtggtgtatgtggggtgtgtgtatgtgtgttgtgtgtgcatgtggggtgtgtgaggtgtggtgtgtgtggtgagtgtgggatatgtgtgggtgtggtgtggtatgtgatgtttgtgaggtgtgtgtgtggtatgtgtggtgtgtggtgtatgtggggtgcatgtatgtgtggtgtgtgcgcacgtgtatgtggtgtcggtcagcagtcacttcctgctcagtgtctgtgggaatccagccagtcccggaggctgcagtctggggagtttgtgcaaaagtgtccagtagccccgtgaactgacctgcctcataaacgaaatctctcaggtagcaggaagagtgaccattcgcaggcaggttcatgtttctgaaggtttcttgcttatctttcggaaatgaagtgcagacttctacatcgcacatttatctcatcactttgattttaatcccatgagtgaaagtatctttaaaaagctgcatgcacactcccaagcatttctttgtttaaagaattatgtttttgaatattcaagttttcaaagctttaaaggtatgaagccacatctttcattttagaatgaagataccagcaggcaatgctagcaaatgtgagtgagcttagaaaatatgggtgatgtggatgaagtcaccactggattctgaaatatttccaataagaacagaaaagacatcttagcataacactgcctttcaaagaacattaagggtatttaatttcatccactcaatataaggagtagaaatcagaagaaacatatgtaatgatatcctatggtattttgtccataaaaatagatgacttttgcaaattttcattgctctttactctggggtgttttaaaacttgtgtttaggtgggaggggtgaaggtgttacagaatcatctacttaaatctgcccttctgtggggctgtcccttcttgggtctgtggttctgtattcattagcatctccctcggtcactggtctggaacctccacagggacagacacagcaaccttggtgtttcccatgagctcagtgtcgagtgggtgtttggcaaatgtgtctactgcaggaccaaggagggcgggggggggtccttctagattgcctcccatggctggtagtgctccaggtactacatgtggcaacaaaggcatgaggtctgctctcagtcctgagaaacacatgttagggacacagttagggacatgcagagctaaggctcaaaggcctatgctcgctgagccagtaatgcttgtgctgctcatgtgtcttcttgcctttactgttgcaccaaccgtggaggctgctgccacctgtggagccctatgtttacctgcatggggacaggggtctgcctggtagaacagatccaggtggtcctgagcagggaagggataggtccttgaccgcatttgcccaaaattagaggtgagcactcatcagggatcacacccagtcagaggggttgaaagaagccccaggctgggcgtggtgggtcacgcctgtaatcccagcactttgggaggccaaggtgggcagatcacttgaggccaggagttcaagaccagcctggccaagctggcgaaaccccatctctactaaaaatactgaaaattagccaggtgtggtggtgcacgcctgcaatcctagctacttgggaggctgaggcaggagaattgcttgggcccggggaggtggagagttgcagtgagctgagatcgtgccactgcactccagcctgggtgacagagggagaccctgtctcaaaaaaagaaaagaaaccccaaacaagagggaaggtactgtccagtgacggggggtgcaggagggggctggaaatggagggcaggggaggaggcaggtgtgggccccccaggcttgggacagagacagtgagcaggcttccagaggcctttcctgctgggggctgcagcctcgctctgccccagcacactcacgcagcccggcccagcctggtgggcaccactcgcagcctgagggcgaagacactgaggtgttgctgcaagaaacttgtggccccaatcttatgtccacttgagaaagtcgtttattcaaagccttgccctaaacaaacaggaacattttgccctaccacttgaaatacacacacacacacacacacacacgataaagaacaaggaaaagagagaggaggagaaggggaaggaagaggagaaagagaaacaggagacaaaacgggagggccctgaacttcctggccccctcctgagtgcccccctccatgtgcctgggcactcttcccacacccacttacagcacaactacaggaaatttaacgtttccccgcggagttctatttgggaagtaggaagaggccaacattttagaatacatatcacacagaatgttctagatagagatggaggttttggtgctgcctgcagagccttgacatagacataattaggaaaatacatccatgttgaaatttcccaagtgccgcccccgcctaggcttcaacttgggtttcgaaggtgtgtgatgttttaaacaaagagacctgttcaaatgtcagatgagggatgacagaaaaggggaaagtgtctattgataaagaggtgcccgccatatcctgagccccttgttaggaactaggaggggtctgcaaattccatcatgcattctctggaggcaaacccaaagtcctagtttagtcctcttacctccgtccatgaggttggcccagtaaatgactctgaacccctggagaattccattcaaggcttccttggaaagtgtggaccaggatattgatatgctttctggtgatgttgctatggcttggacattttcgggggggtaactgggcactgaaatcaaataattagaatctgtaataactgtgggtggtttatgagcaaagcaataaccgaaaaagcaacgtattttaatatttcaatatgcaagcaaaaaattgcactcaaccccaaaatgaaagaaaaaataacaaagatcacttccctggaaaaatcttatgataactcagtgctcagtaaaatatcatgagtcaatgcatatattctaatggattccatagtctctctttccaacttagtttctttacttttaggacagttgttgggacttgagtcgtgtacccttcttaattttattgcctgagtagaaaatcattgtttgtctgatttattttccccttactcttggaagttacttctttaagttgcatttactttatagagtacggtacctctgtatttagtaatatctggcatataaattggaagctgaaccattgtaaagtgctaaaaagtagaaacataatcatagatttctcctgtctcatcctcatccctttctctagagggaagagagaccatagacaggtcagaagaatattgaaaatatttttagtactgagcttttgtaaaccttaaatgttggcgctggggcggtgcaaaatactggctgagacacgcatcttaatgaaaaatgagcattgaagcaaaaacaaaggcatatttaacgactattgcaattatgaagatagacaattccagtgttcaggctgcaagtcattgaagactcctctcctcgcaaaaattgtcagatattacaggtgcaagtcctatctgcctccgcaaacctgtgatcaagggccgggcgcggtggctcacgcctctaatcccagcacttttggaggccgaggcgggcagatcacgaggtcaggagatcgagaccatcctggctaacacggtgaaaacccgtctctactaataatacaaaaaattagccaggcgtggtggcgggtgcctgcagtcccagctactcgggaggctgaggcaggagaatggcgtgaacccgggaggcggagcttgcagcgagccaagatcgcgccactgcactccagcctgggagagagagccggactccgtctcaaaaaaaaatctatgatcaaatgactaactgcacaagaggtaaatgtagtgccagcttcctgccttcaaagctaccacttattgctacaaataaccccatatcttaacttcctgcctaaaacactgtgcctctggataccagggttctctattttcaagcactactggaaatttgagcttctgggttattctcagtgacatggtggaagggctaattaatttatctcggccgctagggggcgatcgatcactgtgcaatctgaaaattccttttctctgtactcagaatgcttgaaaataggaaacaatgaaaaataaaataaattttaaaaaaccttcttaacatttgggagaaagttttttagcaaatagcatttctgcattctcgtgagacttctgcagtaatagagagagccttgttttcactccagaaaagcccaattcttgtacctgaaatgaatgaggaagagtctgaaaagggagggacttgctggctttgcagtccagccctgccccagggcgggcagatcagcggggtgggcgaggtcacgagggaaggcttttccacccgagaccccaggccctgcaggtcactgcaaagtcgtggggcgggggagtgcgaggttgggggagccccggggcagacccgagggaacctttgcggagggaaaagccacgaccaggccccggccgaacctaccatcctcgagagtggtggtgatgatttcctgagaagaaggccccgtgccggcccggttacaggcctgcaccaccaggccgtactgagtgaacttattcaggttgtccagggtgtaaacctcactgtccccgctggtgtcgacactgataatgttgaattggaagttacccccagtgctgtactctcggtaacctatttggtagccacggataatcccattttgcaaatgtttcttgggagcctaaacaggagagaaaagaacacactaaagaagtcttgaggtaggacaagagcgaaatcaacgcccacacccacgtaggaaagcagaaataaagtggagtcatcgccacgatgctggggcggtggtccggtagcagccgcaaacccacgtacagtgcaacttggtctgtgccaggcacccttcctttacctgtgaatgcatccggccctcccagcccctctgagccactggaccgtcaatggacacaggaggtcacctgagtatgcatggcaggagcggaatctgaacatgggtgttgggccccagagcctgcgctctcattctgtccttcatgatgtactggttgacttgtctaactggcgagaaagtgtcaaaatacagatcatgtttgtggcgtctccaggtacgcttacgaccgggtgagactgaccctcaggcctgcacccagcaagaactctcgggctcgctgctgtgtgccaggccttgttccaggcaccagggaatagaattgagtttggaaatgtaagaagacaaaagaaaagacccccgtcctcatggagcttacattctaaggaaatatcccagaatcacagtgtttccaggttgaaaactggcatgggaaggtgagtgcacacccaataggaaggtaatctctttcatgaagccccgaatcattctggaatgatttgggggtgattaaatgtggggcaagagagaggctggtgctaactccaccctgctgatgtgaagatggtccaccaggtcaaagtaggatttaggctgatgcgtaggactcatttagaaaccagagccttttcaaggatggtataaggctgggcgcggtggctcacacctgtaatcccaccactttgggaggctgaggtgggcggatcacttgaggtcaggagttcaagaacagcctggccaacatggtgaaaccccgtctctgctaaaaatacaaaaattagccaggcatggtggtgggtgtctgtagtcccagctacctgggaggctaaaatgggagaatcacttgaacccgggaggcggaggttgcagtgagctgagattgccccactgcactccagcctgggtgacagaacaagactcagtctcaaaaagtaaaaaaagatatgcgaatgccaccaagatgaggctctagggaataaaggttttgtagactttcaggcagtcaacagatatgtgtgtttatgtgtatgcgtgtatgtatacatacacacatacatgtgtatgtatgtatacatgtacatatgtatgtatatacatatacacgtacacacatacatttaagtacaaactatggatctggatctctcaagcctctgaaagctttctccgtcctgaaagtgtttataatcgacctgcagagaggaaataagcacttaagaacctgtagagaactatgaagtgtggaaatgcatggtaagaaagtgaaggccagcaggcatctagaaagtgtgagtatgggtggtctgaagtggtgggaagactcagagcccaggtgggcttgacggagggggggaggtggcggggcacggctcagagaagtagaaggaggatggggtgagtggagcctgcaaagggtgcacacctgcccagcggtaagtcaggagggaacggacagagtggagcaagaccttgaaaacctgccaaatgtgaccgggggagggcagacaatgagaagtcagaagaaggtttcgagctgatgaacagcattgatggattcagcaaacacttatggattgcctaataataacttcccaggggattccatgcctcagcctgtcattagtagtaagtctgacttatccaagagcagtaaaatcatttttgtttttcacagcaagtttctccatttatggttttcttggactccacttgcttttcccaacagccaatctaatttagtatattcatggtgccagcaggtgtcagtgaaacagtcgcgtaaaccatttatttatttgtatctgttggctcggagttagaccctggtggaagagctcataccttttttattataaacaaatgtctatgctcctctgaatccacagatgtgctggcttttgcattgatgagctatggcttttctcactgtttagaaatagatttcaagattctatgttttgaaaattcaattactctatgtgaaaattgttttgctgcaaccactgaattacatttatgtgacctaattaattaatcaaatgaatttccctgtaaacgtcacctataagtcaaatttaccaacaaagagatttcccctattttacctagtgttttaatgttagatatagtgacccaaataaaataatattattttttaaatgagatttacatccattaaatattctaattgttcaactggctcccggtgaggctttaagcctccctaagacagcaagttggattcacagtatgggggctgtggagtcaggtcaagaagagtagacagtaaagtcaaatgcctgtgagaaagtgttttcatagagccaccaatttagctaaatcctccacaagaatgaagggacctgcttgctgacatgtagttcctccagtttggggggattaatcctgcctgtgatctgtttgtacaggtagaaaggagaaatcttcccttgtttcctctccatgggtgaaaacccatcctaactagcttaactataatagacaacgcaggtgtttttgttctgttccatttcaatattttgttaaaaagaaaaagaaaattctttacatttttcttagaagaactacatttcagtcctgtggttctaaaataaagcttattttttcttagttgatacttctgcaaaatattgtgtggaataattatctcattttgttttataataaaagtaaacaaccaccatttctatccaatgcaattctattcacattttgatgcatttcagtctatttatctaaagtaaagtgttttgccccacatagctgtgtttgtagcctgtacaatttagtgtctgagtttttcttcttcatttaatatgctattatgattatattcccatctttacttcatagtctttaaatatcatattccatcatattgatgttttattttatttaacctttttttaattgttggggatattattgtttccaggtttatttactaccacaaatgctatgttagacaccttcacaatatagtttctctgtttctaagtttatttattgaactcaagtcccagaagtagatgaccatcttattttttaagtccatgtttcaattggctgttaatgagatagggcttttttgattattattcttccagatgtgcaatatcatagggtaagttaagggattatatcacaaggaacaaacaagagagctctcctctatttttcttaatattccaattttgaaatgaaatatatggagtagagttatgcgttatttgatggtagtagtgtttttacatctttttttttcagggtgctaatatgatctatagttttcatgcagaataaattgttgcacctgaggaagaagtgagatgtgtttcttataaagggaacatatactttcagtttcatagcttgcaggtccccaaactataaggtttaaaaacagacttaaaaggtagtgggagaggatgggagcagcagccagtggttgcaagctttctctgtggggtgatgcaaatgtttacaattatggctacggctgcacatctctgtaaacatatgaaataccactgaatcatacacttaaaatagggaatgctatggcatgctaactgtatctcaataaagctgttttttacaaaggtagtgtgctaactcatctctaggttatctttctatttcaattacaacactaactggcacctccaccatgatgaccaccaccaccaatcaatgcttaccacctctgcaggtcactgtcaccactgccaacatcaatgccactccctcaggtcccccacacagccaagccaccaccatcactactaccatctttaccaccatcatcaccaccagcttcatctctgtcaaaaatactgtgaacaccaccaccaccagcaatagcatctctaccactgacatcaccaacattacaaccaccagtatcaacatcactgccataaaattaacctaatggtagaagcacctctatcacttcttccaactttaccaccatatttatcacaaacttcaccaacaaaccacactttaacctccactacttccatcatcatccttgatgttaccaccatcactgtcactaaaaagatgcttcactttatcactatcccaaaaccaacaacactatcaccaccaccatccatcactcaatcactatcccaacaccaacacaactatcaccacaaccatccatcactccattactattccaatattaacatcactaccaccgcaaatatccatcactccatcactattccaacaccaacattgccatcaccacaaccatccatcattccatcactatcccaacaccaatatcactatcaccacaaccatccatcactccatcactatcccaacaccaatatcactatcaccaccaccatccgtcacttcatcactatcccaataccaccatcactatcaccaccaccatccattacttcttcactatcccaacaccaacaccactgtcaccacaacatccatcactccatcactatcccaacaccaataccactgtcaccacaacatccaatactccatcactatcccaacaccaacagcactgtcaccacaacatccatcactccatcactatcccaacaccaacaccactgtcaccacaacatccatcactccatcactatcccaacaccaacaccactgtcaccaccaccatccatcgctccatcactatcccaacaccaccgtcactatcaccaccaccatccatcgctccatcactatcccaacaccaccatcactatcaccaccaccatccattacttcttcactatcccaacaccaacaccactgtcacaacatccatcgctccatcactatcccaacaccaacaccactgtcaccaccaccatccatcactccatcacaatcccaacaccaacaccactgtcaccacaacatccatcactccatcacaatcccagtgccaacatcactataacgacaaccatccattattccatcactatcccaacaccaatatcactatcaccacaaccatccatcattccattactatcccacaccaacatgaatgccaccacaatgaccacaactactactacctctaccacctccacttccacttattgaacactgttttttcccattgtaattggtgctttatgtatattatttcattttctttccctaaaaaaccccacacagtataagtatgcttctttacacatgaagaaacaaaaggtcaaatatgttaaaacaactatctcaaggcaagtacagggtaggaattctccaaagttgtatttggtattaaccgctcatagagcctcagagaacttttcacccttttgcaaagtttgttagttttgtaaagtaatagtatacatggcatttctaatcagaggaaaatttaatagatcacatgaagagaaaattgtatatttttatgcataaaagcaagcaaaaattctttatcagggaaagtttaagttactttattaatttgtagatagactagtcagattgaaatttagaaatgcatttaaattaaagaaatccttgtggatgtattttaaaacaacctctgaaaaaaatccataaatgtagggattttgtatattaagtgtaagaaatgttatggcctgtggttcaggttttcgaaaatgacactagaggctcactctgagttatggatgagtcagtaggagtggaaggtgtgcttagtggagacacgtgaatccatttgtctggcagtgggcttcatattcccaaggcaaattagtgcataagatccttaactggaaaattgttttgaatgatgctttagacatctttgcttggagcatgtgtctactaggaacaaagggagatggttttctggggtatagagaatatatccttatagggaaatgatctttagaacactgtattaaggttgttaattagcactgtagaacaattgatacatgggtggaaataatggttcactttcatgaaactcagtgaatgaggttaatggtggggtaagaagaaaaggaaaacaagaaatcaggtagggatctggaaacatattttgaatctgagttgcataatattggagaagacaaatttcctaggaaaccactttgaccatgcctctttgatctctgtctcccgatctcagtagtacctgttgtgagatctgatcgctgcctcatctctcaagactaatgcctcctgggtgttgcttgctcacctgcgttcctctctgactgcctgaaaaagggtggggatcccaactgtcttacatattcccaccttataaaagctgttgtcaaaaaatgttcttccttcttctttcaaagaatacccccactactccttctctgcaggccagctcagcttccagctcaccagggctcttccctagaccactcccaccaagaagccttctccctccctggtctccactggcattcactgatcacttctacctcctctagtggccaccattctcaatgaaacgtggtttcaaagaatgtcattgcaagctctagaatgcaaagaaccctacagaatgaaatctcacttgttatttccccctgtctaaatcggggcttcaacactgtggatgttctcagaagatattcttgcagatggagaagagaatggttttgaacacacatgagatgcaaaaaaaagaggtgggtaagaatgatcacaggtacaggtttataatctaactgggtaaaggactgatagcaagggtatgaagtcagaagaaattccttgactgcagacacatggtttagctgttgaagagaggcctggcttagccactacagaagtggagaactcagcagtctagtgtgacagccgggaagtgtggattcaagctgagagttggcttccgcactgggacttagcctgctggcctacacagaaggatgacaggttgaggcaggatttggaggggttgagcttcattgcccaggccccaccagggatgaaaatagcttctgatgagccaatttatttggacactgtcattcatttttttccttcttaaaagaaggattccagaaagagaatttgctcacttactcagccagccggtgggttacatgtttttatgatgatggacctgcagatttacagcaaatctcacctggtaaccagtcatcttaagacaaattaaaggagtcctttgaaacgtaagcatatggaaaaaaaaaaacacaaaaaaaacaaaaaactaagggctcccttctactcctatttaagaactcaataaaacaaggccctttccacagggaaaatgttgaaatttagaaatgtgtttaagttaaagaaatccttgaggacgtatttacaaacaaccgacttctttcctaagtgagtgctttctgtttgcctcttctcaaatccccttgaacgcagtgcaaatctaagagaaggtcatgcctgctccttgttaggtttctcacacaaagattgtttttcccatgttgaactttactcccccattcatttgcctttggattcagtaatgatcctgatttcttctcatttctttcatttatctgccatctgtggaatgctctctcccccttcctagcctggcaggtttttttctcctgtagtcctcctcaacagcctcctttcatcctcccagatgccctttctccagcttccaaatccctcccaacctccacttcctttaagaaaccttctcttttgatctccatgacaacagtcgcaccatgtcaatgtatttgcacggtgtgcaagtgacttattttatatgtccttctcaatcagtcggctgcaagccgcctgtggcagatgcatcatcctttaaagggacagtaaaacagtagacgtgcaaatgctcactgcacctgcctggatgtgaatgattagaacaggcatctcttgtgctgaagaccaccagccatgttctgtttccctcatgcctcctgcccccttcccattgaaaggaaatggcctctgctggatgtgcagaattcacctgttggctggagtctgctaagagcctcactgcagaatttcacgtttgaagaatgctgcctttctcaggcatgctgaataatttagttgggaaatgaattgaacattttctttatagattcctccaaatccacttaaaatgtaatctatcctcatttcccttatgtgacaagttgggtggacagtctttttcatctttgtgcgttttctgcagcctccccttacctgctttccaacataaacagtagccattccataagcttgctcagtgaatgggtgcatcacattgaacaaaccttaactgggcatctgttctacacaaggcatggcacaaccagggacacctttgagtgaatcagtgctcagaatactgcctgatacttgcagtgctgaaggtttgcccagagtactatggaggggcaaatcgtggtcagaaggattgccagagaagagcatacttcacctgagctaaagggtgactggacattgccttggagggtacaatgctgtcgccaaagcaattggcatacacagctgcacccaggtgcaaggacagaagacacccaggaatggagagaggctcaagtgactctggggtgaggtatccatggtgatcacaggggtgggggacggtacaagcacagatgaagctagggacatatctacgggacagaacctatggagcctgtatgtagtggtatggtgcgctaccagcaacatccacatcacctggaaaactgttagagctgcaagaactggggacccactcagagttcctgaatcaggaataaactctgggggtggagcctggtgaggtgtgttttaaaaagccctccaggggataccagtgctccctgagtctgagaatcactgttgttatcactgggagtcactcagtgatttagatttggctttgctgggagagactatttagttaaaaagcagcaactatgcattcccccatttctcaggttagccagtagcccattttcctggttcttggccaaacaaaagggaataaatgcacataaaactgttagaccttcctggtcttgggagtaatttaaagatctaccttactcagcactaaagggattctgctttacaataggtataggggtggtgtgagaaccagctggctatcttggtccatggacaatggattttgagggggctatgtcaggtcgaggagacctcttacattattgcctcaaataattcctttcctctcctctctcctttctttcctctcctttcttcttccttccttccttccttcctcccttcctttccttccttcctcccttcctttccttccttccctctttttcttttatttttctttctttttcacagggtctcactctgtcacccatgctggagtgcagtggtgggatcatggctcactgcagcctcaaccaccccaggctcaaataatccttccacttcagcctcctgagtacctgggatcacagacatgtcaccatacccggcaaatttttgaactttttttgtagagatgggtttttgccatgttgcccaggctggtctccaactcctgagcttaaataatctgcccaactcagcctcccaaagtgctgggattaccagcagtgaaccactgcttccggtctcaaatgatatttttgttcatatatctctccttagagttgcactgtattaaatacagtatctgtgtcctaggtctcataatgggtagatgtatggccacgtgactggctcccccaaagtcattatcttttgaggagctaggaaaggatgagatgtccacatttcatgaaatagaaaagggccacatgacctgataatgagacagtgcttagaacaaaggggctgtgcaatttcagtttgagaaataaatgataaatgacagattatttgaaataggcactgtcttgagagccaagaatgttacttgcaggctgcagctgccatattctagtcagacttggcagctgaggaggaaagagtggccaaggtatatgtgggctttgccttgagacacaaatgcagaatgctagaaatagattgataattttatgacatggaattgaggttaactactgcaaagcaaaactccatttattccatttctaaagtgtaggacagcttccgctttattcatccagccaacaaacacctgtgacatagctcctctttttgggacactccctttttgaattctgttgttcctcatacatcacaccacctgctaaccacagttaacatttcctaccagccacagaggcctatcagtgctctctgccaaggaccacacaagggcattcgggctttgcttcctatgaatcaactctgagggctggcctctgggaatacccccacctagctcccgcgcccaacaatggggacctagagggtgcactctgatgcaaaagagggggtatgctagtctgtgagcctgaggctgggccccaactatttagcggtggctgagtgaacccaaagggctttggcccaccacacacgcctggagggcccaacccagagtagcccctctgcaggtaatggaggccctgtaacggcagtgtggccaaggagggcagggcaggggcccgagaaaggccacagagataagggagggaggggcaccccgactccaatctgataaacaagcacaagaggcaggatttcaaaggcatggtcatggggccatgaaaaatgctcggaagtagttttgcgggatgggagaagacagtgtctgattctggaagctctgtaagacagcgccaggggagggccaatcatgatccaacaccgctggtaaagaggtcagtcgggcaggggtggagctgagtgagatgaaggcacatccacatccacctctcaccccaacaaaccactgggtctgcatgctctggaggcatcctggatgtcttgatgagaaaaggcaggaaaggagggtgaagaagaatcttccttggaacgaaacaggccctttccactggggagggcagggcgtgggaagctggaggccaaggcagggagccaagccaggagtcgccccagccagtgctctgacatgcacacagggcagcctctgtctaccctgtaggtccttaaactggaactgcctccatttccctcccaccctatatataatataatttatattatatttaataatataaattaaagaataactaagagaacccttaagtgatgtaggaggagagggtaagtatggagacaaactgagtcctggaatccacagggatgaggctgagagccagtagcgggtgagagtgaccctgggctggaagggacacacagatgggaacggcactgccaggaggcaggtggaagctgtgacagtcaaactaagacagagagagagagagagagagagagagagagagagagagagagagagagagagaaaggggcttgtaaaggagtaagcggcatcagtcacacgccgggttgttgcagcctttgtcatttttgctaagtatctgttcagaagaaccagagaagatccaggtctcagaaggagcctgcccactgaaaggtgagctttaattttataactggaaggaattcctgagtgctttacatctgtgccaaaagaaccaatgaaccagaagccatttttgagtggggcactgctataaagctacctgaaaatatggaagcaactttggaactgggtaatgagctgaggttggaagagtgttgagggctcagaagaagacaggaagatgagggaaagtctggaacttcccagagacttgttaaattgttatgatcacaatggtggtagtgatataggcaaagaagtccaggctgaggagttctaagacgagatgaggaacttattgggaactggagcaaaggtcacttctgttatgcattagcaaagaggttggagggattgtgcccctgccccaaagatctgtggatctttgaactggagagtgatgatttagcatatatcatatatggcgggaggggctagccttgtctcagatgagactctctcagttggatgtggctccctctcgagagatcatctcaatccaggaaataagggttgacaaactggtccctcctccagatctgtttggctgcttgtttttatgtggctcttagctaacaacggtttcttgttgtggcttacatttttaaatgattgaaaaaaatcaaaagaggaagaatattttgtcatgtgaaaattatgtgaacttcaaatttcacctttcctaggtgaagttttactggatcccagctgtcttcactcatccacgcatggactgcagctgtgcctatgcagcagaattgagcagttaagaccgagactgcagggcctacaaagctgaaaatatctgctctctggcccattagagaaacagtttgcagactcgtacaggacagtgctgtggacagaaccagcatgtgaggtagaacttactgggtgtgctgcaggtccaaggcagggtgggaaggagagaggggagaaaggttgacaggagaggcactactaagaaaggagcattggagaaaggcctgggctctgcccagtgttggttagagttcgttactctccttttatccatgctccaatggatagttctaacttgtgttctatcagaagacaaggaatagtaatgtctgcagtaacaatggagctccagtcctggattcaatatctgccctctatagctcagtagggattaagaggaggatggcattctttctctagagctaggctttgtctctctttccttttcttttttcttttttttttttttcctgagacagtctcgccttgtcacccaggctggagtgcattgatgccatctcagctgactgcagcctcgacctcccaggctcaagtgattctcccacttcagcctcctgagcagctgggaccacaggcacacaccaccacacccagctattttttttcttttgatagagatgaggtctcactatgttgcccaggctggtcttaaacccgtgggctcaagcaatcctcccaattcagcctttgaaagtgctaggattataggtgtgagccaccatgcctagcctcttatctatttttgggtaatgaaaagctttagccttgactaaagagaattttagacatcaacatgcatgaataggtatttgcgaggagaatattgaaaaagttgtctgggcaaggcacagtggctcatgcctgtaatcacagcacattaggaggccgaggcaggaggaccgctgcaggtcaggaatttgagaccagcctgggcaacatagtgagaccttgtctctacaaaaatcaaaaagttaactgggcatggtgatggtggtatgcacttgtagtcccagctactcaggaggctgaggtaggaggatcacatgagcctggaaggtcaaggctgcagtgagccaggatggtgccactacactgcattcagcctgggtggtagagtgagaccctgtctcaaaacaaaaacaaaaacaaaaaaacaaaagaaaagaaaaaaagaaaagaaacagttgtccaataggctactgtatgttccctgttaggaatgtgctagaagcattcagaccaagggcccctgtgaacactctggcttatgttgaggggaaatactccacaagtccagatgcaacacgtgccacagattccacacgggcccacgggagcaacacaggcactccctgaatcacactctccttcagtgggaagtcttgtttcctaaattcactaaggatctgccacctaaattcttctgttatttacagaaaaacaaaccctgtttccaacttcaaattgttactggcaggcaaaacaagaaggtaaaatggttttatttcttatacatctataattactcaaagcacaaagtacttttatttttggtctcaacttaaatttttcaaaagaacaggaagagtttattacaggaattgaaagaatttgaagtagctttcagcatttttaatacaatgaagagtttggctttaaaaatgttatgggctatcttgaaatagtttgttacatcttagtgcattaacttaaatgtatttgaactagtgaaatacgtttgaaggcacacattgtgtttttctgtcttgcttcatgctaccttgaaaatagtctggaaaatagctgtgccctcctggctggggttcttcctgtgatggaccctaaccaacttcgtccagccgagttgccataataataacaataaaactaatgtcatgtttcttcccttgccttaggagaggggtccatgacatagcagatgccatttgatgatgtctatgtaattcttgattggatatatgttttcctttttcattctaacatctgtgccctgtttactaacttatgtatctcacttgatttctctgaaaagatgggaaatgtcatcagcgagatggcttaaggactgctgtctgaggaaatacagcacattaaacagtgtatatccacctatgcactccctgtacggatggcatccatgcattcataatgctcaatgccatattaactttagcttgattttccaatttgttctctgtgaaaagcagagttaggattatatgagaactgataaaactgtctaagatggtcttctgaatacttttattaaattactacctacccatctatttttaaaaattaattaattaaatttttgagacgagtcttgctctgccactcaggctagagtacagttgagcaatcttggctcactgcagcctctgtctcctagcgttcaaggaattattctgcctcaacctcatgagtagctgcgactataggcatgatccatcatgcctggctaatttttgtatttttaatagagatagggtttcaccatgttggccaggctggtctcgaactcgtgatgttaagtgatctgcccgccttggcttcccaaaatgctgggattacaggcatgtgccactgtgcccgaccctatccatctattattaggttactgaaaataaacttctattttttgttgggaaaatttcaccacatttacatttattgggagatatttgccatcagaaatggcagtgctgtccagagccattggtggggtgggcggaatcagcatctaggatagggatccaaatcggggttgttaatcaagggaccaccttatggattccagagtgggcccacatccgttatcctctatggctatcaagtcagcactgggaggtgaggagagaggagaattcatcattaaaatgcactgctactttcttggttatgacataatgaataaaacacacaactcagaactagagaaaagggttcaagttccaataatgacaaatcaagtgacttaaggtcattttgttaggtgtagagatgggtgtcgtatctaattttctgaaatttaatccagtactttttacactgtattctaattatatataatttacttgttggaaatggatttaacttacgctaatgttactttaaaatgtgatgaaatagtgtcaacttatatttttacatgtacttttcagttttcactatgaatattacatgtttgtatatatatgttactgtaaagcttcctagtgaatattatgcatagtgtgcttattagacaatttaagtcattttcaatatcattctgaccatacacaatttttgacctagtgtcacaacttcaggacctggtccaattgtaaaaatgtaatgttgatgcactaagaaaacacctaaggatgagcgtcaatagatgtccaaaatacccctttagttgcaaccttatttgcatttctgataatatgctctttaaatcaggcaaatacaatacttgccttctaaagttatattgcaactttacagcttataacctaaccgttatacaaaaaatcaaagtgcctacacttagattttttgtgttcatccagactcaacgtgaaactcttagaagaaaccatccaacaggatttctggctcgacggcagacggccttggtcctaagccttagtccaagttcaatttgtgtcctgtcaaggccactctgctggagaggtacagctttttcagtggggtttgaatcaagaattgcctcttaggctgacagtcccagatagtgtctcttcccagcctgcctgagcatcagacctagattccacccctgtggctgcgagtagctcttgcaaatgcagccagcattttcctggctgcgctctaggctggaaaccaagggaactgcctgcttagttgaggagacctgccggaccctttgtgcatgcaggctggcagctctgtcctgggacagagaactggagtccttgaagaaggcccatcacatggctaaaccgagaggagtaacccaatgtatagacggagagatgcagaatacattccaaatggtataaataaacaccatggcttcattaaagaaacatgcatagtttacatatacaccaaaaagatgcaaatttagtcacctagggctttctagaaagtccacagttttttttttaaaagcaccacctcttgatatgaaccttttatgataaaagtaaacaatggtaaatggtttatgcattaatttaacgcatattaattgcactcctgctgagggtacagtgaacacacaagacatgtcctcaaccctcacggaacctagagtctagtccacctaaaaaagttgagaaagaacaatcttactttatacggatgaccagagattttgaaatttttttttcttttcttgttatcaaggaaggaggttagactcgttaatatgagaagggctaaaaattctttaagtatttgtaagacatgttggtgttcaggaatttcaataaggctattataaaaccaatgctagaaccaatggattagttcctaaaagcaaatgcaaacttttgtcatttttcatagcctaaagattaaagtgatagttgaagaattaagtaaagtttatttcaaggcaacctttttgaatttcagttgatataggaaaaaagggtgtctactcactatgaaagttactctaagcttaagtttacaatttggaaagaaaaggatactacgtaagaatgtaaatttcatatatctttaatttttatggggttgggtataatttataacatgagtttgcaaggaatagtaaagggagttaatatttattgagcattattatgcacgaactacaatcttggcacttcctagtaattaactggttgactgctcagaaacccaggaggcagaaccaggcagcctgggtggaagtcctcaatctgacagtcaccagccttcagaacttgggtaagttcctttgacttcaggatctccctctgcacaaaactgggtgttcccagctcacagatcaaatgagataatgcatgcagaagtttagcattgtgcctggcggggagcaaatatctctaaggacagctgtcccagttggccaggaaatactagtgctggaaggtgcctccaagactgccttttccaaggtaccttgcacttccctggggtagagggattttagtgcagaaggcaagtggagcctgcagtttattaaacgatgactacggaggtcactggaaataaggcagttttgtttttaaatgacagactgagtcattttcctgttgtaagagctcaactctgaaacttaataggttgtaatgatgcctcaattagctggaattattgggtatagtggagatgtgatattctggttaaaaatattcttcagattactgaaatttaattaaatctctgaatattcaacttagtattttacagaaatcatacctctctttcttaattctaaatgagaattttgcttattctcagtaaaattttcacgcagatagtacaatactgagggccaaatggtaaaattattctcaggatttttattgcaagtaatcactttgataattgttctcagcacagaaatatttaagcaattgaccatttcatattttggggacagcctgtggttctgcaaagatttcttatttaatgcaaaaataaaacaacaacacaaattttatatcaataggaaaaaaactctgtcttaaattgcattctctggataaatgttttgagatgtatataatcattaaatattctaaataatgaatgttttattttatgagtgaccatggcaaacacacacacacacacacacacacacacacacacacaagcatgcacacaagtagctggtaatcacattgtccttaatttgcatccaaagagggtcagctgattctgagactgattaggagagaaggtgacaggcactgctaaaagagacactttaggagataaactaaaaattggaattttctgaaaaaccaaagaattccttagttgtacaatgttcaggtacttcatcaaatatgttatcaattatccatagctttaaatattctttctgattttgaatcagaaacaaaacctgccatgaattaaattgtatttgcttacacaaatccttttgtttctccaagaatgtcaaatgaaactttattgtcatttacttttaattttattcagaactgcttacattgtcttttggatttctgtcaaggcatggggtagcactttaattagcttaatatttgtaaaagtatttaagagccctttctgagacttcatcttgcataatatagacatcataatatagcctatagaaagatattcctcttgaatatctttctatgggcttatatttgggatgtgaagatgtccatttcccatgaaacttatcacaaattggaccactactgccctttacttttcaataaactatattgaaaattaccatagtagaaactcatatgaaaagtggttggtcgcctggtgtactgagtgtggttcacatctttgggtgcctgccgttgtatagtctagggcatttcactgtatcatgagttagacctgagctcagcatgtttgctctctggagatcctgatagcggggatgccatctccatggcagtcttggaaacacgtaatgcttcacaggcaattgtgatatggaacacttgtcttctaggcctcttcattcccagctcacatatacactcacctctccttcacttacccattcattcattcatggaacacatgccagccatgagggatcagaactgagtaagcctctcttcctgctgccaaggagctcccagaacagtggaggggatgcacatgaaacagactgcagaagccactgggtgggaacctccctgagccatcgccaagagcaatgggtaacatagagggtgaaactctaattgcactctggggattcccatcttcatgggggcagtcatgcacaatctgagcctcaaatgagcaggaatggacaggagaggtaagcatgttacaaactgcctgaacactgacaggagagacgatgacacttgtggactgctgcttgggtaggtatccctgggaaggcgaggcaagataaggggcctgaatccaggtgctgcagctgatgtaggatggctgcattcactaggtcctgagcaacctttgctggacatgaaagattttaaaattagaagctcttctttggtgaaagaaataactaagataaaaagggtgccaggtgtggtagctcacgcctgtaatcccagcagtttgggaggccaaggtgggtggatcacgtgaagtcaggagttcaagaccagcctggccaacatggtgaaaacccctgtctctattaaaaatacaaaaaaagtagctgggtgtggtggcacatgcctgtaatcccagctacttgggaggctgaggcaggagaattgcttgaactcgggagacacaggttgcactgagcaaagatcgtgtcattgcactccagcctgggcgacagagtgagactctgtctcaaaataaataaataaaataaaatgaaataaaagtggaaagttgcttattttgatcaatagagggtgtcattacagaagcagtgcttattcaatgataattaaataaatgtaatatctatctccagtgttacagaaaggccaccaaagtgccccttacctttcaaaggcttagagtctaaatggctattttcccaccaaaaccccagagctatttcctcctttaccctgtgtctctgtactgaatgcatcttttacttctgatcagtgtccgtgaccatgaatgagcttccaccttagacttcccacgactgcatatgtccaccgtggctgacagatgtggggctccctctttggggctaacgctatttctccttctttctttctccttacacaaaacagatattctgaattttatgccataaataaaggcatgttatatgtaacatattgtcctttacatatacttaagatttcgtgtaatagtgtccaattcgattgaatcagtggtgtcctttaaaagctcattatataaacaggccgatgtgaaatgctaagctggtgacagggcagccccaacctcattagtcagttagatcaccggcaagtctgcctgctgacaggccatgccacaaaggcccactacagagatagattgcactcctccatgaacaatgtattcagtcgattcacaatctaatgagagccaggcttccttttaatagtcccacaacatttcaccctttggcactaaagagaaatttaactgcaatgcactgacttttgtggctgctttctacagagagagaaaggatacaatgccttttaaagcctcagaagtttccatttttagttataagagctagatcctctgtggacagacacctctctcatgcaggacccaaaagatccaaaaagcttttgaggccacagtaatacctggtctttttcagggcaaaacacgagagaatgtgtaaagctagtgggtaaaacttcacagtcttcaattcaagacagagtgagtcagcattccatttgtagagtggcgggaatgcgtgtggggttatggcttgctgagcgtctttattctacaatgtgtgtgatgctcgcagggggtggatgtgcttacaaagaccaatgacaccacctcccacactcctcggcctgcactttctatgcagctaaacagtcatatcacgctgcccgctggaaacacaactcattggctgcggttgagaaacgctgacacaaaggggctcgctgcattaacgcccgtaataccaaaggtggtatccgccccaacaatgaaaatccatttttgttacagaggctggtcatcttatgaaagaacccatactagaaggaaaacaaacaaacaatcaaacaaacaaacagatgcaatggttagaagaggtgtgtgatgtgaagaccttattgtagttgttggctgccctcttctcccagtgacgccacagaaaaaaaacggtgaggaaagagacaagaaaaaaaatcacatgccatgagagaaattcagagcggggatagttaatgcaatgttacagaacttttgattcgataataacgttctggatgaaacggaatttggcctaagacagagccatctccaagagcacattcaggaggatgactaatgccatggcccaccaggtcagggccatgctactgacctgaaggccatggaacagtggtggttggtgatgagcttgctccagaatcaacactgcttccttacttgagaaaatttgctatggaaaccatggctgttgaatgaaacgatgtgcttagtgatgcaattgtttacactgtggctcaagctttctttctctcccagctacttccaacaaacactaaagtaaccagcagccagtctgcctctatgggccacacatggggtagcactgccctgggagtcagtggattcaacagctcacttcactggcaagaaaatttaggggctttcttgagaacacatctagttagtggcacagtgaggacttggcctgttttctgccacctcggtggactgtctgccaccgcatgctttgccatttaaaaaaagcaatttgaaaacatttttgctgggatgaaatgagagcatgcagtcagggacatcaattttactatttctgtagagaccactgcttagaccttgatcaagattcaaggaagaaaaaaaaaaaagatacaaccactttattctctgagacacagaatttgctgtaaaagtattcaaaatgtggatacaaatactgcattttaagaaaagggctttcaacttaattttgaaaaaataaaagttttgtaaaattcgagagtcttggtgtcataacactgaacaggagtgaagggctcgccctggggggaaagcaccgagaatacaaatgtttgctgagtttaccttccatgtgaccctgatgctctgagatgatataggctccaggtgaacttcctgaggtggaccatcaggagctgtaaggaccaaaaacccacaggcaggttagagacgctttccggagcagatcgaagcctacacagccaaaggtggtccccgaggacaacccatccctatgtttggcacagagaaagaagtttttagcggtcatgggaaatgtcaattttgtagaattactgtgtccaactctaggcctttgtttatttgctctttggaaacatgaatcttggggacctatcatggtattccttctcaccatgtctttgacaacctcgtgaatcaatcccaattttgaacaaggggtacaacagaaagttgcaaaacaaaatttcccttatgaaatgctgtctatggtgtgtattgaaggtccttctctccccgctggaagctttgcttagtgatgtggtattggggtttctcaattgattagaatgacttcgggcaaaaataatcaagattcttctgcctttgggtgtctttcatggcttttgttcttcaattaaaaacccttgtggccgggcacggtggctcacgcctgtaatcccagcactctgggaggccgacgcgggcaatcacgagatcaggagattgagaccatcctggctaacacgatgaaaccccatctctactaaaatacaaaaaattagctgggtgtggtggcatgcacctgtagtcccagctactcgggaggctgaggtagaattgcttgaatccaggaggcagacgttgcagtaagccgagattgcgccactgcactccagcctgggcgacagagtgagactccatctcaaaacataaacaaacaaaaaacaacaaaaaaacccttgtgaaccaggggctctagccacagagtgctgaagcaatgttaaagaggaaacaaaagtgtgcaatttaaagcaacctatttctgctgagtgtgcaataagtcagtgggccaatgagagacaatcccaattacagggggccaatgagagacaatctcaattacagggagccaatgagagacaattccaattacatcccagttagagctgataggcatgtgttggaaatgtgctacctactaggtacatggtgtagaactaagagatgtaaaacattttgccaaccaagagttcagaatgtaatcagagctatgagatacacacactgaaagaaggttgcaatgcaaggcagcaggaaaacaggtgtcttctgagaagcagaagcaaatgacgacacagagatcagagggaaagaatcctttagattaaaaaatgtttttggattgacaatttttagatcactgcagaactacagaaagccagttctgtggacatttgcaaaaggttgtatggcacacgggagataagaaagctgaagtagtggatatgaactcattttggggagtttggaagtaatgggaaaagtaaagctatcttatagataaagggtagatttggggaagcgcatgactaagggaaagctcccttccttttttataaaggaagaggaagttctgagtagtagcatgatgtagttgctaagttgatgggccatttgagttttttctgtccaagttcacattctggttctatcacttgttggctgtgtgctttttctgcgggttacttagcttgtctgtgactccatttctctctatatataatgggccaatggaatttgtatcatagggttgttatgaaaacaatgtgctcagtaaatataagaaatcataatcataatataattatcattaagtgtttgtaaatagggggaagcaaatgggagaaatttaacaacaacaacaaaaggtaaacttgaaggaataatgaatgtcctggcagaaactgaagagggcagaagatacaggctatggagtgagtggggcaaaggaacaaatacctctgggatgggaggagggcagagcgacgggaggccttaggtaggcttactggttgagggaagccaggtgagggcagacacaggtaaacttactggttgaaagaagcgggttgaaacctgattgttgcttttctcaacaatatgacaataagccaagcaggaaatcagaatgggaacatgaaggagagagttatgggctttggaacaaaacaaagtcttggaaaatggctatggtctatagaaaagggtgcaccctgtgtcttagggcactaaggcgctctatcaaggtgcccctccccaggagtcagtgctctaagatgcagggattgctactccaagaggataatgggactccacagctccgtcctcgcactgaggaccaagcaggaagctgattccgcaggtcagggctggcgggactgggagagaatgatactataagaatgccaagaaacgaagccgattctccagcatatgtggtttgttatggtttagaaatatgagtttgaaaggaaatggggacattgcggcctcgattttccagttaagatgtacttataattaaaacaaaggtgttaaaagacaagagctggagagagaggaggtgggggttaggtctctgggctgtttgttccctgcacccctccttcacacacttgctgatgctgtccctgacatctgatccaaatggcccctgtcctatgctttctccaccatcgtccttatggggatccctatctctcactctgataccccactcccaccccacttctatgcctggtgacagtttctatttagttcctaaacattaattctggtctctattgtactcttttaaaagggacatggccccagagcacaattcacactgttcacccaccctagtaattttctgctcccagaaggcacctcgccgtcctctccacgctttcgttccgcgcactccctatgcaccctgtgtcccagccatgtccaaaacacacgggacccctgggtagagccgagccttttccctggggctttcttctccctccatcagggtttgccgcccatgcctgtgagcctcccgctgcagctgacacctgcctaggcctggggacctgtccctgtagtgtgcatatatgtttgcgtgtctgtctttgcatgtctctggtcacccagcagactctacatggcaccaggaactaagcccagagtgagtccttgctttgaatgggtaaagcaatttgtagatgctgaaatgctgagcatgcatccctctcctcagcaggtccagggacagctggcagtctggagtgctacagcctctcagatctattagttccaaaaatgcaaaggctctgctagaactgaagttaaagtccagaacaggagccgagggagagaatggcttccagctaatggtgatgattattgttgagcctctgcacccaatttcttgcacatggggtcaagctcttaggcaggaaactttggacctcaaattcaataaaaactcatggaatggatttccctcacacacagataattctgtgctcattgaaaagcacacggttttccataaaaatccttgaaaaatgatttttgagtctgacagctatactgaggctgggttactttaatttagttacacttaactgaatttgacaagaagccagtttgttaggaattggaggcaatgtcaggagcactgtctcatcctgaatcctctgggctccctggggcatggcctttggtgtggtcctctcaggaagatggcacacaagagttgcaaccttgattttccagttgagatatattcataattaaaccaaaggtgccagcatagtgtttacaagaatgtccccaattctatcagatagcatacatatcataatgtaatcatgaattgggagtaacttacttttccaatctggtctggtatttattttatttttcttgagacagggtctcactctgtcgcccaggctagaatgcagtggcactatctcgactcactgcaacctctaccgcccaggttcaagctattctcctgcttcaatctcccaagtagttgggattacaggtgtgtgccaccacgcctggctgacttttgcatttttagtagagatggggtttcgccatgttgcccaggctggtctcgaactcctggcctcaagtgatccgcccgcctcagcctcccaaagtgctgggattacaggtgtgagccaccatgccaggcccaggtctggtattttatgaaggtccccactgaagaggagagggggtacagttcttgtatccaggacagacttaactgtttttaagaatgtaacagctttattacttagcctaccaatgctgccatgatttgtcagtaatgtatttattgttctgcctgttccctgaagtgaaagcatttggatccctcctcctaaaaaaaaaaaaaaagtgatgaaaacagtccagacaaaccaaaataatttaatttgtacaaacacacaatagggctatgtccaatatcattaggaaggttttttgtttgcttgtgttttacaaagggcactaaattttctactatgtttctaaaacattactttaaaaattttttaaattataaaaaatttcccttctttaagaattttattgctttctgtataactcctgagctgtaattttttcataggttatcatctcattgccaatgatgcctataaaattacagtccaaagccgattgagtttccaatgcaaaatgtattaagggtcaaaaattaggtatatccatttatttaactaaatttgaaaattgtgttgacattggaaatttaagaatttacttacatggtttcaaatgtaatatatagaaaaagcagaattggcttccccactttggaagccaaagtgggcagatgacctgaggtcaggagctcaagaccagccttgccaacatggtgaaacatggtctctactaaaaatacacaaatttgctgggtgcagtggtacatgcccataatcccagctactggggaggctgaggcaggataaccgcttgaacccaggaggcggaggttgtagtgagctgagattgtgccattgcactccagtctgggcaacagagcaagactccatctcacaaaaaacaagtgattttacaaaataaactctgcatttctaagaaatccaaaactcttcgatctgtaaagcagtaataagcgaagactatctttataatttgtattatgtttgcaaaggtaaaagtcaggacaattcattctgtttggctgaaaacacagggatgacaggcacctcctgattgccaaacgcatggatctccgctttgcttccctgtcctgatccttcctggctacgctgtctctgcttctgtccctccccagctggacaacctcccactgcccagcagctcctgtgtccctcccagagctgagactcaagcctcggtgctccattctgctccaaaatactctcctccctgtctcaatatcttggctttagccagcatcttggggcctcatcattaattgatatgggctcaatcaccccagtgagaaccagtcccacatttttgcctctggttctgattgggagatttgccttctatgtgccaggtcctaaactaggcaaagactgggatacaaaagcagaaaaaaatatataaatttttaaaaagtagtgaggagcagctgcataattctacaaacacacgtttgtcttctacaggagttgggtgggtgggcgagaggcatgctctgtgttggacaaagggaaccaagacagtatttagtaaaaatcaaaatacgacaaagaatagctggtgcccagatggggaaaggctgaagtcatgtaataactacttattaaataaatggctgatttatttaacctacttatttaattagcacatcctatgtgctaaacaccaatctaggtgcctgggatacagcagtgagtgagcagaacaagcaactccacctgccctggtgggatgggatcaaagcagaccataagcaaaataaatcaacaacttatacagtacactgggtgctgatacaagcgactgctagaaggagagtggtaagggaggcaggggacccagtggagtgggcagtgggttgaattttaatagggtggccaggattggattcttggagaataatatttgaaagtggtaagggaagagacgaagaacatttcagaacattccagaactgttccagaacctttcaggatagcagacaggggtatacacaatgtgtatgagggacagcaagaaggccgataactttctttagatttaattcccaaagtttcttcaaacccaggatggaggagaatgacaaaaatctacagaggcagatcgctgagggcctggttggtcatggggtgtgctcggctcttctcgctgagtgaatgctgtgcatttgactcttactgaagaacacattgatgccgccctctgcactaatgagcactgctagccctgtgtttgcttcacatgctcctgacttttattccttctgccctcattccatcctctcccctccaccccagctcagcacataggaaactcttcttccagatcacagctgctgccccggaatgggaggaaagatgaggcaaggacttaactcagtgccagattcattggaaacccagtgactctgcatcatgacccttccataatccacaccttctattctctgatggtctgtcaaattcagtggtgtttcaatgagcacccactaattgaagctgcatgttctatgcacagatttatagtgaaaataatgaagggggcagccatcccaaactcggtcacaaggcactaagtgactcatgacctgcagggggcagctgctaatggggaagttggtctgtagcaagggttagctgtgaatgtcatgtgtcacgtggctgatccgtgtcaaagagacacacttcgggtccattaacagctcatctcattaactccgactgtgtcacttattctcttgactgctcctttgttgtgggggctgctggtgctaggggtggttggggaagccatgaagactgcgctgaatggtgtggtcttggcttcatggctattctctgaggtcgagtgtattaaagtggtatgataacgctttatgcactttcacatgcaacacatgcaaataaactgagtagtttggggttggagcaatgagatttcccaacattaggtagggacactatgccagtggcagcaatcccttcctcactaagctttgcagtagatacagcagaaatctaaaactcaaattcccatggtggccagacttcatcagagatccataaacatttctgtaaagactcagatagtacaaattttgggctttatgggcccatgttattctttttttttttttttaaagatgaaaaaactatgcttagttcaaggtctgtaggtgaagtttggctcaccgactgtagtttgctgatccttcaatgaatggaggatgggaactatggctcactgagggggtatggtcagcctctgggatggccactccatgcttaactccagctcattgctgccaagcaggaactcaagaggaactcaaaatttagattttcagctgaaatttccagattttaaaaattaacatcgaatttaaaagtttcgcacaacactgagccgactcacatccacaggcctggtctgtcgtgggctgcagcttatggcctgggacatgccctattccatcaggatgcggggagggcacctcaagctccagatgcagccatttcatgggtggtcactggagctctgatgggggctgtattctttccccatcttctttcctctcagccttcctgtcctatctttcacctttctctacttttctgcatgaagtccttgtcttagtcttttggggctgctataacaaagtactctaaactgcatgacttatacaccacagaagtttatttatttctgtttctttttttgacaaggagtctcactctgttgcccaggctggagtgcagtggcacgaccttggctcactgcaacctccgcctccagggttcaagcgattctcctgtctcagcctcccaagtagctgggattacaggcatgtgccacaatgcatggctaatttttttttgtatttttagtagagacggagtttagccatgtcggccaggctggtctcgaactcctgacctcaagtgatccccctgcctcagcctcccaaagtgttgggattataggcgtgaactaccgtgcctggctcagaagtttatttcttacagaaatttatttctagaggctgacaattccaagatcaagatgccagatttggtgtctggtcagggctcattcttctggttcatagatagtgccttcttcccatgtcctcccggggcagaaggggtaagtgatcttattgggccttgggcctattgtataagggcatactgatgctattaatgatgggtccaccctcacttcctaaaggccccacttcttaatattattgcattaggaattaggtttcaggatattcatttgaaagggaaggcatgaacattcagaccagggcacccttcagaatttcactgtgggtttaatccagcatatattttctcaacacacacatacacacacacacacacacacacacacacgcacacacacacacacgcacacacacatactctgctcattgtgacacccattctaaaggcaatactgtgggtaatgtttataaacgttcatctcatactttcatctcccttatgccagacacacacaagggacagaattgtaagcacatatgccccctgatgtggagggggccacagcccctccacatcaggtggtatatcatcatggacagcagggtccatgaagacatgatgatacacctcaaaggctactgtcagcaaaatccctcctctgtcctgagctgagtagtccctaactacacatgggagatggaaaaaggcattgcaccagggaggaaggcattcttgaacttgacttttcaaggaagggcacagaaaaggagacatggaacttgtagtgccttcaagacaggggaagaagcacaacaataggggtctgggagcatgcaaaggcaggtgagtgctgggcattgggctctggggagtcactaagtgtcattgcaaagtagtagcattggggggcatcctcgtgtgcccaagacttgggtactagattacagtaaaagtgagtgggctgacagcttccggaggctcccatatgaggaataagggaacagtgggacaaggtcacctcaagacagctacagctcctaaaaagatgtgcctttgggtttacctgctgggaaggggcagcagtgtctacagcccctgctcaatactctaatgaggatgcctttggccagagcaccccattctaggtaagtcacacatgggaaattgactttttaatttcagtcatgcaaacctatgaaccaagacaaagacaagttatctgctgtagcttttcatttctagaacctgctcctttccttcccttccccttagctcctctgaatattaaaggagaggggctgtgtggggctgccacagccagcacacccagatacaatacaaaaggccagcctgggagccaaagaggcagcatctgcatctgtctgcagacatgccaggcagctgccctgcagaccagcaccccagaggctcttcacctggccttctggcagggagagagctgcttccatggcaactgccagccgcagcagaggtcacagaggaaacgaagaaaaaagcaacaacagcagcattaataatggcaatcagaaaagcaggtgcaaaatgcaccaccggaaaaatgctgttttcccgaggaggtggctgggatggggcgagattagaaaagggcttgagagagaaggagaagattgagcaggaagtcagagatgacattttgggctgaaggatggggacagcttattctccctaagtacccagcataatgaaatctcagggatctgaggaagttagtgggttgtttacatacataattaaatacaattctattttttgcagaagcagattaacacttatttcccacttatttctgagacatgcaaagtattttcagagcttgagtttttttcagtgatcagatatgtctgtgtaaggagcagaaaggcatcataatgtccattttgcagatgagaaatcatacagagaatccaagtctcagaaatggctcactctcaggcacttcagcctaaagatcttctgtcactcactcttgaaaacaattttcaagaactgacatcttccagcattgaaaaatgggcattcctctgcagttcaggaagagttgtacattttaacctattctcttgaagacaacactgattacagatatcagaagggtgaaaatgttgcatttgattgatccagccatctgacttcttaggatttaatctaagaaaatgatcttggagatagcaaaagacataccaccaggatgttcattgtagtggtgtttatactaatgaaaactcgaaaataattgacccgtttggcaatatgagatttgttaaacacatagtgagagatatcattacaaattgtagaaaagtacttaagagatacataagctccatttatatttgggatgctgttaatgagggtagcagagatgaggtggtgggaaggaagccaagatcaacctctcttgaaagttgcaacaaacctccggtcttctgttagccatctgggtgtggcaatcaccttaatcttggtgatggagaaacagggacttgagactaagctgccatcttccctgcagtagggagtggctgattgctctgatggtgggcaggaaaagaagaggtaggtttgggagctggacaccctttccctacaataaatgggccaggcatgcaatccttgtggatgaaacccaagcgcagtggcttcctctcctcctgccaggaggcgggctgacaatcagcattcatggaccattgcctgattgctcagttctctgcacacctgttaatttcacccccccggaaacatgagtggctcgcagtgtgttaaggggtgtgaatacactggtgcgtgcctgtgtgcatgtgcgtgtgtgggtgatgaaattatttagccagttatcactgcctgttcctgggttagctctcagtgggaaaatgatggaagctgttttgccttctccacaatgcttatctctatcttctgaatttgcaacactaaatataatgttgtttgtaatagaaaaaagagcaaaaacattatttttaaatattgatgtttctagtcaataaaataatctgttccccttcccacatctcccgcacagtaagcatgcttgcagattcctagttaagcattactgcttcctcccacactggacttcacagggtctcaggaaagaaacacactcacggttctcctgtcaacctggattccatgtgtccaaacaaaggaattgtaaaacggcatgattctttgaatctcaccagattgttagcctcatacgtctttcttttaagtcttgggtatgggaaacttgaactaaatcctatttgaagagcagtgccttcaaagtaagatgcagagcgctgtctgcgttttttatagggcacagaactacggagagcacgcatcaaagacctccgcctagcacgggcaaaggtctgcttctgcatttaagcatctgagccctcaagagttagctcccgggctcctctggagcaaggttccgcccggtcccacgtacctgcctcgtccgccgtgatggtgagctcgttgctgggctcgctcttgccaatccggttcttggcgtacatgcggatgctgtaggtggaggaagggtggatatcaatgatggtggccgagttcagctgaggggaaacatctttggttctctgagcagaatcccaggagtcttttgggttttgtttttcaaaaaagaagagatagagacgtgagtttttttcctctgcctttgaaagttcacaagtaggaattaaaaaccaaaaaaaaaaaaaaaaaaaaaaaaagacggaaagaaagaaaaattacactcaaagtgatttctgaatgcaatgttcccagctttctggcagagttggccatcagaggggatgtgacatcccacacacattattcacgctgcgagggacatggggcaacaagccagctgagttcagggaggggtgatggaggaagcacagatcagccgactgggggagatctcagaaggcaaattccagtggtggaagctcaggttagtggaatggacgatggccactgtaagcactcattgtataggacagtacaatgaactatggtttggatagtacccctgggcccccccaaaatccctggcatttgaaaaccagcaaaacttcaagccatatcagatcctttcctccccaaatagagtgtggtaaaaacaagataatcccatacaaaccaatctcaagttccagaataaatcctgattaccaaacatattttttcagttctattttttgaaatcatttagtgccaaatccttggttgtaggaattatttttcaaccacagctaattataacagcagcacctactttgtgtgaaatgttatcactgaatctgtgacattttgtatctggtggttttcaggcttcaagcaaggatgagaatgtcaatacgtggttcttatatcaaaagagtttgggcagttgttgactgtaggtgtgtggtcgacagctggtattggctggggatgaaaaaaggagggcccaagacagtagacagagatggtgcctacatattcccaccctcctcagggtctgccttggtggtgctcaccacacaagtaagtcttccatggataatctgaatctgtgttccctgctagactttaagctccaggagggcagaggccatgctggccatacccagtcttttatccctagtgctagcacagtgcctggctcatagtagacaaatagtacatgaatgtttaatagaggaacaaataaaccacaaatacatggacctctgagtcttgggaatggggccaatcactttgtcacactaagggtgagtatggcagtttaggggacttctctgtccagagttaaacataaatgcaagagattttctggaattgaagaaaaaatatgtggcttaaagactgcttttggatactgtaacttctcagagaatgaagcctaatagaatctgacaatgaatattgcagttagaaggaaaaagcatatttggggtcaagaagattagaggtggaaaaacatgaaatacaaagagttggaaaaaaattgacaaggggaagaatgggattcaatggaagacaaatgaggagaggaaattttatatcaatgaaacggcacacacctatgaggcttgtcccacagagagaaagccagaccttctgcagagatgtttaggaggatgaggaggaatgccaggtgccacaagatgcagagacatttgctaagtagcccctggaggaagtaggcagttgtggtggttgatgcctctgcccaggcaacattgaagtttctgaaactgacggggccaatgaagatacagccatcttcactggaggctcttgtctgggagttggcaggcagcctggagaggcatatgagtgtccatgactgcagtcccttacaccaatccaaggcatatggtggacctgggtagggtggggacagtcccctcttggtggtcactgggcacctccacatccatgccctataggttcctttagctcagcccctatctcagtgatgtcaccttgttcaacagtctcccagtgtgacttataaatcctctctgatgctgcgtttgcaccctgtctgtagcaactaccactaactccctccaatgggctgggggacccgttacaaagcccatcctcaccctcctgtccgtggccttcccagactctccccagtcacacttgccacttttcagatcttggatgtccatgcatacatttctgtttgtgttttacgcctaagaacttttttattgggtcaatggtgcattcttcctagttatatttatatctcaattttcagtttcctcctcccatcaggtcaatgtgctgggcattttcaaacgtgacttctgtggccccaaatctgtgggcacattggaaacaccttggggctttttgataattctgctttcagacctaccaaaccagagtctctggggaatggtgcccagaaacctgtgcttttaaaaaggctccctatcttggtcattccgatgtatagtttggacagactgcttcatttgattaaaattgtacaacatcctgtcaaggtaaggtttttatttccttagtgaaagtcaagaaactcaagccctgttacatagctggtaacaagaagggctgggatttggcctcgcctgtgttatctccaagttcaaggtcatttttctgtaatgcatgacctccacatactctctgaaaacacctaataagacaggattttgatatttccgggcacctgctgaaaatctcgtatgcctagaagaagaccttctggcaaattattgacttgacaatgcacagaaatcgtttggtcaaatgtaagagaagaaaactttggccaagaatgactgtaccatctgtgggtttgtaggaagactgagagggctgtataggctcggagttgcagcctggtttaggaagatgtcagaagcattcacgaaagagtgggcgggatgccatggcttgctccagggagactggtggtgtaggaggatggggcagttcagagtcccactgcagcctctgtgaggtgaggaaggagtgaagagctgacaggagccagtgagactgcgctgggtgcttgctggggagctcgccttgggggtcagataccccaaatccagtggatgcaagagcaacaaggactaatataagagagtggacttggtatgaagaagtgctgttagaggctaaagaccagaatgagtgaaggtgactgaaagttctggaggtgaattacatgaaaggtttaacaatggagaggtagctgggagagggagcgggcccttcatgttggtgaataggaggaggtgtggggacacaggagagccccttgttctctgtcttattcttctcaaggataacagtcctcagggtgaactaggggtgggaagaccaagagaggagaggggttggggtgtgcaccttctgtgtcagagtctgtgtttcctggttacctttcagggtgtgacagagcttgccatggtgctgaaacctggtcagagacctgtgagccaccacggacaggagggagggacaagagaaactgtggacaggacggaggcaccggagaaactgtggacagcagaggccaacagagaaaccgtggacaggagggaggtaccagagaaactgtggacaggaggggccagcagagaaaccgtggacagaacgggccaccagagaaaccgtggacaggagggggttaccagagaaaccgtggacaggggggggttaccagagaaaccgtggacgggggggggttaccagagaaaccgtggacgggggggctaccagagaaaccgtggacgggggggggtaccagagaaaccgtggacaggaggggggtaccagagaaaccgtggacggggggggttaccagagaaaccgtggacagaacgggccaccagagaaaccgtggacaggagggggctaccagagaaaccgtggacggggggggttaccagagaaaccgtggacagaacgggccaccagagaaaccgtggacaggagggggttaccagagaaaccgtggacggggggggttaccagagaaaccgtggacagaacgggccaccagagaaaccgtggacaggagggggctaccagagaaaccgtggacaggagggggctaccagagaaaccgtggacggggggggttaccagagaaaccgtggacaggagaggcaacaagagaacctgcggacaggagatggcccccacaggaacagactctgaagggcaggctgccttccaaggaagggaataaagggaggcaacaaactgcagacgaatctgctggaggtccccagacaatatgctcgaagggatgttaaaggtggccttgggtccttgtaggggagaagcagtagtccctgggaatcagaaaatatggcaaccaaggcaacctgtgtaattgccacctatgggagaagaagaatgttccagataaggaagggacagcttcactgtgcctgtgcccgctcagatgacgcctctggtgctgccactgggcatgaccagagttaggggggcaggagatgatgacaggagatacaataacaaggacttggggtgttcagtgtttcctggaaaagagtaaaccaaggaaagtcatctgttgtcaaatcctgggaggactgtcatttggccaaagggttaagaggtgggaggagagacactggatccaggaaggtctattttggtgcaataaatgtaagaacttgtagcagtcacagctggccaaaggcagagctgtgctccctgggttagtgagtttctgtttctcggattgttcaagcatagagtgaatggtcacttgcagaagttctttctgttacgaatgtgaagtactttaatacattggttatatgctgctttctttgaaaattaatgaaaaggaaaggaaaacttttggggggataatttcaccgttgcctaaaacagatgttgagagtcaacaatttgactaatggttattatgagtctcgtatacatgtcaggcactatgaggggcacagggacatagcataaggtttgtcagagacaattccagccctcagggctcactatggcccatagggggacaactgttcagtggggtgcagatagtaaattaatagtcacaagcccaccaagtgttccaagacatgctatgaatagtgaaggggaataggtagtcagggaaggcttcctggaagaagtgacatttaggctgttattaatacttgaaggatcagttttctatgtactcagtctaaaactacactcacttaaattatggttgtaatttttatacaccaaaaatttctggaggaagaaactaatacatgaaaaatctgactaacacaactcgtacagcagtgagtacaggtgctatctactctcagcacagctccttcctcccagggcttccaaactgaaagtaattgaagttctgtagggtcctggtagagaccttggtcatggacttggatctgcttgtcctgtgggcttttctcctgggacccatgctgccccttaaaatgacttgctccagggctacataaacatcttagccacaccactggccctgtctctggttgaagtagggcatgaaggatggaaaagagtatccctcaatcccgcctgtactcagctttatagacaaggagctttcctgctttggttatataaaccatgatcaatttatacatttaaagatgctgttgataataatgattcttagatttcaattgcatgtaaattaatgcaataaacatttacagtatgctcttcacttgacattgtgctgggtgctggggatcccaggacacagagaaccagagtccctgcctttgggaaactcctgggtaagagtagggagatagtgaggacacttagatgctgagtaagtagtttaacacagagggttttagaggcattttactcctaagtattttcctgcatgctggagcaatctacaagctaccacctattagatgttgagtatgctccagacaacgaggaaggcgttttcaatgtcttcccttcttagagttcaccaatttccattgagtgtctccacatgttgggtgcggtgctgggtgttggagaaatgagctgggtgaaaatagacctactaggtgcagggagcccccaaggagcctctagcgtggtggaggtgaaatgcattaatcagcatatttgtcagtaatcatagagatacatatatagtgacccataatgccacctgcccagattgaaagggagaaggagctgggtgagcacctgagaattgagatctatggagggggtagtaactgggtggctcagggaagggaggactccaggcagagggcagctggtggcctttgtggtctccttgccagtcctttgaggtggatgcagcagtgcccacttcacaggtgagatgcgcaagcgagggtgcagagctggtgcaacgcaggcccagcagcgaatcccacacaggctgggtcccaaatcactgagcccaggcctgccaccagcatccggcaatgcccgctcctccatgaggacaggggaggtcctgggctgctccagtaggagaggtctcctgtgtgctcccgcaccaacagcatgggcagcctgcagccccatagccagtgcgcagccagtgagataaagggctgtccctgtccccacggtgctcactgcatctgtctgagctctcatcactgtcactaagttccaggacagtttctgctcaaatgtgcctgcctcacctaagaagcatttgcttcacttcaagacctgtatacatgaacttgtaagaaaggcaaggtcagcctctcctccctgggcccttgggaaacctgttggtcctagtccccaaaagatgcttgttcagctcagcactgtcttgggtgagccccccaggtcactgtgcctcacccctgagcccagggccctggctctgcagcatttcttggctacggtgagacttgcagtccaatcaaccccggaaggcccttcctcagactttgtgtaagtgacacctcacttctaggcccccagttgcaactcagaggccgatgacctgagccattccatctttcctcatgtgcatttccaacccagcagtcacagatactacttttcaaaacactattttttgttttgatccatatcttctcaatcttcaaattctgttctcctgaattcccgaagagtcacccctcggcttgcctttgcagtcaccatttcctggctctgttcctggcttgctcttgctgaaacatttcctcactcctgacctgtggttcccagctgccttgagcttgattttttactacagctttagtgccaaagatattagatgggtcacaactgggtaatctgaaataacgtgcggtatccaggaagtgaaaaataaagctgcttttgcggcctagaaggattttattaacccttcccatgctggtggtgctcgaattcctcatatcttttatgagacacagtaaaaattctgactagaggccactgtggtggtattctaccctcgcccaatgcatcataaagttcaaaatggcccgggcattgttccttgaaggcaatgaatgggcacacctgcagcggccctggcagcagggtcagttttatttatgggctctgggccgagtggtcctgggtgcagcagccagtgtcgccgatggtccctgagcatttccaggaggttgctccagagtgaattttcctttttctgcaccaaccaccactgcacagtttatccgaccaacaccaagcacagcttgagctcaacgctctgggtgcaggacatgggctcaggctctacaaaagtcacccagctcgggaaacgggaagtgaagggagcaggtgaaatagaaaaggtcatggtgggggcctgtctccatcagccactgcccacatgccaacaggaagctgcaatatcaaggagtccagcaggaagcaagactgaagtctgggctggctaaaaaagaaagaagcagagctgagcctcaacacgaaactccactcccacagcagaaagccaggatgtgcttccagcaaggagactgggggaagtggtgccctctgagctcctgtgagctgagctgtgcgcttacaggtaaaacacattaataaggagaaaaataaaagaactttctgaggtggaagggaagctggaggaagtaaagaacttacctgatttatttttgcattcaatatcgtagcctgtgatgggactgtttccatcaaaccccatggtccacctgagcgtaattgtgcgtgctttgacatctttgatctcaatttcgggagggtctgggggctctgtgccatcaacagaaagactacgagttagttcaaacagagctctgacataaaacgctagtggaaatgctgagcgtgactcacaaacgatttgtctgcattagacaagaacagaagctttttatttggaagcattttctttttcctaatcacattttagggaagagaaattccactttcccaagacttccaattttcatagcccttaagaactggaccaagcctggaggatataaaatgtcacgattctagtttggatctctaactcaaaacatattttggccccaaatgttaaacttccctttcattctggtcatctagtacatggattcctaaaattgagcaaagaaattccaccgctgtacttgtgtgcatgtggcttgactgtcatgggcttgtcatcttgactggttcctctaagggcttcgttccctgtttgggggctttactttgacataatcccaggcactgcaaaattctgctttagcactgacattatacatattcaaaatttcctgggaattaggaagtgttacatggcaagttgaggacacagagatgcctgaggctgagcatacagctcccatcctgaaatgactgtgtttattctcttacgctatcgtcttcctaccttgcactgtgagctgaattattccacggtcctccccataagaattaatagcatggcaggaaaagaaaccagaatcttctctcacagttggcaaaatctatgtgtaaagcagaaagaaattcatctttttcagtaggcaaaatgactttgagccgtaaagctctctctctccactctttcagttctcctgccatgccaagcacacacataggtacactcacacacacacacacacactcacaaaacccccattcctccagactcacatactaaatcacacacatgcacgtatccctctgaggacaaattatttcagtgtaattgaaagtaggcggatggataggattcacgtacattatccatgtcaggtgtagctcattaaattggatgtgtaatttatataagatgtcgtggtcagcttgacatatatcccacatatacattttttttttcatggtatccaaagcaaccatgcctaaagagacagattaaatactgcaggcagggctgggggcccgcaagactcgcatcagattccttttctaggaggattccaggaatggacccttgtctgagagccaatataagcatttcaaacacagggcttccccacctccccaccctgtgtgtgctacagtatcatcctccaaccgcatgacaacagcacaaaccagttcactgctcacagtccttttctctagcttttgtgatcctcttttaacgacagattttttttttattgtggatttttccaaagaagcaagatagtttttatgataatatttttgtcccaaagcccatctcatttttctttttgcaggaagttaaaacatgcacacagcataggccatcattcctgaaggattaactgtcatttaaaaaccttatttctcactttttttttttttttttactacatttgggttccctgctgcgttcataataaccctattcttaataacacttaggctgaagcactatttttgaaggctacttcactaatctcgctgtgtgaaaggggagagaaatagtgcttcgtaaataaattccgaaagattatctgctacttatctgcacccgcttctgtgaaaggaaagacttattcttccaataaagttcattccattgtgttgtatttgccatgcttttacctgcagagtagaaatcacctcttctcccacctccttggtggacacaagataacgggccatctcagggttaatgattcggtcctccttctcccagcggactataatgggcttctcaccatgcgccgtgcagctcatctcctttttctgcccctgcgtggccagggtagtatttggataggatgttatcatcgcaggaactgaaaaagcaaaagggacacaacttgttcagcaaagcagggttcttgattttccctggcaaaacactcaggtaaaccatgcttcaagagatatttcttcaaaatgaaatttattcaagaaactgctgcatgagaatctcgagcaaaataaaggaaaggcaccagaaaaatgaaacttgagtaagtgagccctcagcagaaattgccatgccgtttcatatccacggcacgttgctcttccaaccctgttgagggctatggcctatgtcccttagcacacccagaatgattgatatgggttggctgtgtccccacccaaatctcatctggaattgtatgcccataattcattcccatgtttcatgggaggaacctggtggggggtaattgagtcatggaggcggatctttcccatgctgttctcatgatagtgagtaagtcttatgagatctgatggttttaaaaatgggattttctctgcacaagtgctctctctttgcctgctgccaaccatgtaggatgtgacttgctcctcctcgccttccatcatggtcatgaggcctccccagccacatggaactgtaagtccattaaacctctttcttttgtaaacagcccagtctcaggcatgtctgtatcagcagcatgaaaacggactaatacaatgatgttactggtttctaactatcattataaacaatggggataaaacttccacttttagtcaactttaggtgaatcccttgttgctgctaaccagtccttgtaaccacttttcacaatgcccatctcccacagttgttataaaccttgcaaacctttatcagtcactggagacctcaaacctgtccttcttccataacttatagcagagaatctcgtctccaatttactgagaaaagggaaccctttatttgtgaagcttctcaagtttccttttcccacatcaaaattaaaagaagtctaatacatagacttcttttcttggcaatagatgacaaaagatcccaccccaattccacaagccacttataaattgtagactgcatatgacaaacaccttttaaaatgcatactaagcttatcagaaagtgagagaaaaaccagagaccaaacacaaaagctgatagtgaaaagccagaggtaatatataatggcggtgctttgactacctgagaggcatgacattaaatatgagacctccaaagccaggctcctcaaagggttctatcttgacagaaagtatataaccaaaataataataacaataaataaaaatccacaaaggcaaagagagaagaaagctgcctcagcttgtgttatatatgtagaaaaacaatctctcccctgagaatttataaaactggcctgactctacataggtctgtagtcaaattcatgctaaagctttaacatgaaggtgaccgtaatttgataatggcctgaggagcctagcaaaagctaacatactctagaagaatgtgtcctctgtccaggcccactgaaatgcacccagataaagccctgctggccgtgagctcacaaactgaaactaaagaacacatgagaaaactaacaccatgattgagaaccagcctcccaggacttcagatgatacagttgtcagatacagactgcaaaataactatgcaagaatgtttaaagatattttaaaaatatgataaaggaacaagatgttaacaaaaaggactagaaaggtttgaaaattcatcaaaacataacaacctttttatttgctttttatctcatttccccaatcacaggaagaagctcccttcccccatttctgaggtcaagctcagactacgtacttgattgcttgcctcgtaagacttccaaggtacttgaccatagaaacactgtggcttcttctaagactggcacatactgggtcatgtcttttcccatggcttactagagaggtttgagacatataatgaaacgtcaaaatactaccagttccgtagcctgaacacccacagaagaacctacatttgggagtttctctagagtcagcagccatgtggcagagatgtgccccacagcactgaccgtgtaataagatggaaagtaggcaaattggtgactcaagaaagaggtgccaagagtcctgcatatcaaggacagttgctcacaactgttgtgaaattccttttctggcatttctgagatgcagcaaaactggctgtactgtccccagcctttggttctgatcccccccttcccctagcctataaaataaataaaaatgtttatttttattaatagctttattgtggtataatatccataccataaaattcacctgttttaagtgtgcaattcagttgtacacttaatattgcattcgcttcctagagtgcctgtaacaaattactagaatctatgtggcttataataacagaaatttcttctctcacagttctggaggctggaattccaaaatcaagtcgacaacagagccatgctccctctaagagctctagaggaagacccttccttgcctcttccagcttctggtggccccaggcattccttggcttgtggcggcaaaacttcagcttctgccttatcttcacataatttacattcttctttgaatgtttctgtgtcttttcacatggacttcttatgaggataccagtcactggatttaggacctaccctaatgcagtatgatctcttcttaacgaattatatttgcaaagactctatttccatataaggtcatattccaaggttctaaggggacattaatttttggggatactattcaacccattacaaatatatttatattatccagtacatatacatatataccattataacctgtatacaaatatacacagttgtataatcatcactgaatcaaatcttaaagcatttacattaccccaaaagatttctcctgcccatttgcagtcatttctcttttccccctcaagttctaagcaatcactaatctaccttctctccctgatatggtttggctgtgtccccacccaactctcatcttgaattgtagtttccataaatacaattcgtctcccatagtgtcatgggagaggcctggtgggagataattgaatcataggggtggttacctccatgctggtctcgtgatagtgagtgaggtctcacaagagctaatggttttatgaggggctttccgccctttactctgcacttccccttcctgccgccatgtgaagaagcatatgtttgcttcccctttcaccatgattgtaagtttcctgaggcttccctagtcgcataggactgtgactcagttaagcctccttcctttataaattacccagtctctggtatgtctttaaaagaacagactaacacaatacccgtattacctttttagatcattttttataaatggaatcatatagcatgtattctttagtatctagctttctggatttttttcactaagcataatgttgtcaaggttcatccatgtcatagcacagtactttgttcctttttattgctaaatgatattgcagcacacggatatactgcatttttttaaatccactcacccactgatgcacactggggttgtttctactttggggctattatgagtaattatactataaatattcctgtataagctgttgtgtgaacaaatgttttcatttttttccaggagagattcctagaagtggaactactgggttatatggcaatttcatgtttaacattttgagaaactgccacactgtttgaccaagtggcagcaccattttgcactcttgtggccggagattggagagagaagagggaataagaggaggtgttaagattcagcatttatggtgagggaacaagaacattccctttcaaccatttgagttcaacaatttaagttcaaccatttgaattcaacaggggaactcaaagagtagagattgggtgcacctataaaaaggtgagctggcatgttcctcgacagctggaggcttactggctgtagaaaccccaggctcaccatggatctgccatcacagaggaactgaaggtggtggcactttctgtttggcctcaatccactaatcaagattttttctcatacgggaaagaggctaactcaagataattagagatctcaaagccaacaaaagtaacctaaattacaaaactgtgaataaataaattacaggcctatgaacaagaaaatatttactcctcattctttctctcacgactggggaatgtgaatcagaaaccatgacacccacatataatttagctttgaaaggtgacccctgtccactaccatcaacccccacgccccaattcctgatgagtgtcctgattcctgcaacaccctcatccttagaataaaatatagaaactcttgttgcaaaactgaaaatcaatccatgtttaatgcctcccagtctcctgggcatctcaaggctatggtcaggatttcctattttgcagtgtttgtaaaaaggaaatgtataaaatggtaagacataaaaacagacagttttcctttgagaacttggtaagtcaccatcatcacctcccaaatccagggtagtttaacactcactgactatattccaatgagagcaagccaattctgaagtaagggtttctgtcctattctaggagctccaaggctggtgttgacccagaatgtaattccctagtactttaaaaccaccaactggaagaactgttctccaaaaactgcagcattgttttgaggacttgtttgttttcttctcttttccttttttaaaaaaataatcacaagttttatcgcatttgatgagagaagtaccttggccaaaccatagacctctggtttgtttatgacttgcccatcttaatctgcacacaatactcctcagttttatttagatttctactttgaaagagtgccctactaaaatgggtatttttgttctggttattaaattcagcacttagagagaaatgctctgactagcccatgttctcctatccagctcaagtattttcagccctttaaagtaatggtggaaaggaaaaaatgaatcattaccatggcttctttgcaatgctaatgtttgaaggcatgaccttttcacttgtcacagttatggatgcctagagatgacaacatgtctgtacagcagccctttttgcgaggatttctgaagcataacaaatggatggggtaatttaacagggattggtaccaaggagaggctgtgggcaaaccctgctagcagggccaagggagatccagacccaagaaggctttgtccaaaggttgtgtgctgcgtgcctctcttgcaaaattacccattgaggaaggtgctgttttacatcatatcaatttataaatttgcttcataaactataatattatctaacagcatccttaatgctcagtaaatctgtgttcttatgatataagggagcatccctctgacctacttttttgcagcataaagatgcagtggtgtagtggagctgctgtcattggccagggagatctgattgtgcacatctctgcccagcttggcagtgcagtcatgtctctttcccatttagcttgaaattggcaatggtggtagtatttataccactgaaattggcgagtgctagaaatcacggctttctccatcctctccccctcaatagctaattgttaaacatttaccagaataatacttaggagagtgtttcactatattaataattttaaagggtgttcccatcgtacaagagatactgagaagatagtaagattaagctaagagcaataattaactttatcaatgaaagtaaacccttatttattaattaaataattaaaatatgaacagtttgtcactgtacgttttgacaagtaattcagtgataaattgatgaatatcttaattttttaaccctaggatacagagagaatgaaaaattctatcaataaatcactgatattaaagactggttccaaactttactctcaagtcttttaatgactctatcaataatgcaaaattaatccttatacatttttatggtttttgttcctacctggttctgctgaaaagaaaacagattgaaaagaaaacaactgaaaagaaaacaggagaaagtaccaaacagcctggataatcccgaatgagacaagattcctgtcacaagcatctggctcaatactttcattttatagagaagaaagggtgtcaaatgcccaaatacaggagtccatcaggatctgactctgatcggtcctatttgaaaaccatcatcgtcatgatcaccccaaacataggagatggccaactgtcccagggtgtccaggacttccagtgttttaacacaggaagtctgtatcctgggaagtttctcagtccctccaggcattcagagcagatatggcagaggagggtgtggagccaagaacgaggcagcataaacctggcccaatgcccaagatgggaaactgaggcaggaattacagggttcccgggtgggaggtcaaaagaaggagatgctctgggacataaacacattttaaagctattttttcaagtcccttttaaaccagtcctcccaaatttttattatgaaaaaatttcaaacatacaggaagccaatcagccatgtatctactgcctggattccacagttcacactttaatgcacagtgttgaatcaaaatgtgttttctttgttatcaagatttactgaatacattttttttattattctattttaaaactaccttgggtaaacacatacatcagcgtgggtctcaaaggtcgagctgtaagatggcagccacctgcctggattctgcagctcagggtgcagacccactggcctcctggtgtcccaggtaaaggaactgccgcaccctggcctgcagaggtgatgtggggttaggtggtgcctggggtagagtggtgcccctcacatatgtcttaccaaaaggaaaggtgaggaaggggcctgggagcagagaatctgactccaacctcctgccgctgggactgggcaggacccttggccgtcctgggttttggctttctcacctgagtcatagaggagctgaatgggatcacgggctctcaacctggcctgtatctcggaatcacctagaagcctttaaaataggccagtgctcaggccccaccgcacgttggctcagagtccctgggggtgggggttatgcatggatttatttaagtttcccagacgatcctaaaatatacagcctggattgaaacaactcaatccgatgatccccaaggtcttttcccccactaattgccatttcccctccttctccttttttctttatttctttccctctatccttctgttcctccctcccaattttttcttcatttttcccttccttccttcttcactttcccctctctttcttctgtttcatcctccctctatttctgtctcctgcttttttctgttttctccttcacagtgccataataacaacaatagctaatttttatgagtgttgactgtgtgctaagaacttttccatatactgcataagtatttcagccatacgacatgatggaataaaaacactagccatggaaatgacccaagacacatgagtactattttaagttgattctaaattatgctataaatagaagtgagacacatagacaaaacatttccagcagattaattggatttgcatctatattaacaaaggtctatgcagatggtcaaatagaaaccagacaccaaacaccgcctttaaatgggcaaaaataaagattagaatataagagaattttggaattaatttctacttgacatcttctcccctttctccttaatttctttctttctttctttttttcttttttgagacggagtcttgctctgtggcccaggctggagtgcagtgtcgcaatcttggctcactgcaagctccgcctcccgggttcacaccattctcctgcctcagcctcccgagtagctgggactacaggcgcccacaaccacgcccagctaattttttgtatttttagtagagagagggtttcaccttgttagccaggatggtctcgatctcctgaccttgcgatccacccacctcggcctcccaaagtgctgggattacaggcgtgagccaccgcgcccagcctctccttaatttctaagtaaggaaacagagaactagggggtttaagactggaaatgactagacctattccccttgcctctctcctatccctaatgcaaagttctattttatttagtaagtttattaaaaaatcaatattaccataaaagtaatacagtaaaatgatcttcattaatccctaaagtgatgaatctttcccatcccctctcttcccttctctttcctccttccttcctccagggtctggaaagctaaatggtagtagcagcacagttagttaataacgcatctgtccttctgtcctttcacgtctcagatcattttcatatcatgagcttgcagcaacacatgtgtttctcagtggagaagggattcttaattccatttacctataattacctaggatggggaaactaagtaattagcctaaagtcatacaactagtaaatggaagatctagaaggagaatccaggtcttctgattccaagtgcaaagcctctttcccttatagtagcggaggaggccaagggtgcagagtgtctgaccacaggggtatctgacagcctgactgtcttcaagcctgaacacccttggaagcccctcagtctggggcctgagtccatttacaggagactcctcataaagtccttgaaatttccactttctcagctgcaaggcaagacccaaacatctcccgcaagcctattgcatatttgtagaattaagcagacgagactggctacacaatttgcaggacccagagcaaaatgaaaatatggaggcttttgttcaaaaagcaggaaaaaggtgccattaaagttctaaaatataaagctttttccttccttctgtggtctccctctctccctctgtcatgatggcctttattttttatttaatatcccacttcctctggcatggtgatactggctggtcaagtgctgaccctccctaactcccagtaacagccctgtgacttggcatgcacactcatgtgccccaccacatgcctggatccccaccatcatcatacccaggccagggtggggacgtgtagtcaggcctctctcagtcgaataggtgaccttcagtgacctggagacccaccctgcccggtcatcctctgtaaactctctggtactgccacctagaagcagggaggggtgccacacccagaaatgttacaggaggctgtctctgaccttctccacatacttacccagatccccatggactggatgaccatagccattgctgggcagttgcaggaaaggggagcctggggctccagggggcaggaaagtgaacagctgaaaacctattctggagaggcagtgggaggtgggatgacatgggagctgtggctccacataccctgttcatgctccattgtcacactggacttcacttgcaaaacacaatttcaaagacaaaattgttaagaattcaagatggcggctgcagataatctttggcttgtgggactggactggtcttgtaccgatgatgctgtccctgaatgtcaggacagtactccacttcctaggcagcctctactgcttccagtagaaagaaacagcccaggtaccttgagcaggaggggaataagaagagctgaggagagggcagtctcttggataagacttagatatgagtaaccacaatctggaatctgaagtagggagcccactctgcccatcatgaaggcaatgggtacagaggcaagccttaatgagggaagtgactaatccacttgcaatcaacatcttcccaagccactcaatacatcacgattatctttcattaaacctgtggtccctattccttacatcacctgggagccataaaaacacccacagtatgctgagaatgatgacttccagcttcatcccctggaaaggataagatctcattcttttttatggctgcatagtattccatcatgtatacatgccacattttctttatccagtctatcattaatgggcatttgggttgtttccaagtctttgctattgtaaatactgcagcaataaacataagtgtgcatgtgtctttattgtagaatgagttataatcctttgggtatataaccagtaatgggattgctgggtcaaatggtatttctggttttagatccttgaggaatcaccacactgttttccacaatggttgaactaatttacactcccacccacagtgtaaaagcattcctatttctccacagcctcgccagcatatgttgttcctgactttttaataatagccattctgactattctcacttataagtgggagttgatcaatgagaatacgtggacacagggaggggaacaacacgcaccggggcctgtcggtgggtggggcaaggggagggagagcattaggacaaatatctaatgcatgcagggcttaaaacctagatgacaggttgatgggtgcagcaaaccaccatggcacatatatacctatgtaacaaacctgcacattctgcacatgtattctggaacttaaagtaaaattaaaaaaacaaaaaacaaaaaacacccacagtagtatcttcccagtcacagcgaatacttgctgtcctcaggattcttttttttttttttttggtaaaatacacataacaaaaaattggtcattttggtcactttcagtggacaaagtacattcttagtctgtcttcaaatcagaacacccttggaagcccctcattctggggcctgagtccatttacaggagactccccataaagtccttgaaatttccattttctcagctgcaaggcacattgctgtacagccttcactacaattcatcccccaaactttttcttcttcccaacctgaaacttggcaactcttaaacaatccctattctctccttttcctggcccccaggccctggcagtcaccattctactttccgtctctatgaatttgacttctctggggacctcctataagaagaatcatacagtatttgtctttttgtatctggctcattttacttagcataatctcctcaaggttcagtcaagctgtagcctgtgtctgaatttccttcttttctaagcctgaattatatttcaagatatgtgtacacagcatttttttaatccagtcatctgtcaacggacacttgtgttgctttcaccttttggctattgtgaacactggtgtacaaaacattattttttagagtctgtagaactttgctagagaaaatggcttgagtctttttgcctgtttcttctcaagccattcaaaggccaagcagtattttccctgtttgtggtctctgcctctcagtttcatctccgtttcctcatctgtaagaacaatgagacctgccgcctcctaaggctgtaatgaggattaatgagattatgttagaggaaccctctgagggtgttggaagaatggccccacagaaacaccaagtgtgattatccctgctgcagaatcaaaaatttctcctgtccaaatacttattgttcataagatttcggcaagtgaggctgcctactgggcagctctaatccttataaagaaaatgatttttccagccaggaattaacaaattcttagcacatactaaaatatctcctcagctgggttattatgcttacataatgaagttacttagattataaccgttaatcaaattcatgtttccaagctggagtgggtcatatttgatgctaagcttgaacaagaatgacaacatctccacttcctggcagcttttccaggcccttatgacatgattgaatgtgtcaggggaaagacgaagaacatttagggttcatattacattcactctgaagttatttcaagtcacattattggaagaaagttgatttattttttaagacaagtatgaatattaaccaaaagatatcaaaaacagtattttcctctaactcgcatggaggcaggctggccatttctttctttttttttttccatctgtctggttctgtacataggtactatattttgcccaataagaaagcttcttatttatttatttattagacggagtttcactcttgttgaccaagctggagtgcagtggcatgatctcagctcgctgcaacctctgcctccctggttcaagcaattctcctgcctcagcttcccaagtagctgggattacaggcatgctccaccatgcctggctgattttgtatttttagtagagacggggtttctccatgttggtcaggttggtttcaaactcccaatctcaggtgatccgcctgcttcggcctcccaaattgctgggattataagcatgagccattgtactcagcagaaaacttcttaataattatgtagaaaaaggaaaatagtaaatagattttgatttcctgccatcaatgatagtaaaaaaataaagaaacaaggaagaaaatagatcatgtcatcctgaaaaattgggtaagtgctgtccaggatattaattgcagcaaaaatatattatgagccatgggttagccagtttttaaggtgacctgtggtaatctcatctcctggaattcaaactctccacattttatcactctgagaccagattataaaaggactgtagcttctaccttctacttgggtgccccagttctctctctttctgtctgatcacttgctccagggaagcctgccatgatatcaccaggatacccatgtggcctatggagaggaccatgagaaggacaagtcttgggccaatagcctgccaacaaccctgtgtgggagctggggggtggattccacccccgccacccttcactcttatattcagatgcatttcccagaaggcaagcagtttccatgtggcttggggacagacacagagttgtcatgtctgaagccatgttctaacttttgagcagctgctttatgtacagctgtttttcatggagaaacagagaagataaatcatcatccccattagcactcaatggggtggtgaattctaccatgtcttgtctccatcacccactgcacagcacactgcctgtggctcccagccgttcagtgtgctgtgtcttctggaagctgggctggttatctccttgaacaagtccttcggcctctctgtgcctcaatttctgtacctataattacagcaccccctcctagggttgctgtagagattacaagctaatagctctttagggtgtcccagggatctcctctacctgaagattcttgtccaaaatgggccaacgcccagtattttgatccttccttcaacgttataatctccaccatatttctgattcctaaagtttcaccttttccttgaaaccactctgaccatgtgatcttcatctgtgttaatattcattttccactgtgcctcttcattcaagcattagtggcatgattccattggcttgcatgtgatgcccatatggtttttttatttggttatctggattgtatcatttatttcattcctttttcatttgactatgctagtatcaaggacataaatgcccttttaaaaacatctggtgtaataatgaggatgataattatagctaatatgcattaagttctctgctgagaaatgtattagcttttaatacctacagcaatcctaggaaggaggttttgtaaatatgagtataaaaattgaggcacagagaggctaaatggcttgttcaagatcacacaggtagagaggagcggagccagaattttaaaccatgcagcccatctgtttcccacctgggtatggatgcatgaacaacttggtacatccttggctgcttttgaactgtatgtaaaataccatcaacctttctgcattcatttgtgtctggcttctttccttccaccttatgtttgcagatatctaccatacatgtatagtacctgttgtttctttccttttatacacagagttattatacagccctgaaccagcatcacctgggaacatgctagaaatgcacactctggggtcccacaacctgtctgaatcatcccccacctgggggctgctttacatctgttctttgtggcatccctcccctacccgtcacccagagccttgttttctagtaccctgcgtgcatattgcagaagcagctcaggctttggaatcagcagagctaactttgaggttttttggctctgccaattgataagctataaaattaggtgggtatttatgttctgaatcatctatcaaatgggtgcaagggtgatgcccacctcaatagagagaagcaacacaattaaatacatgcaaagacctttgtagattataaagtgcttataaggttagttttttttctagttaatatttgtgttcatgacttggttttctaattacattgtacattcctgtacggctaaagagcttttcatatatatgtataggcaaggattgtaagaaaaaaagtgttaagataatgggatcatacagatttaaaaattttaaatatttaatgtggtttttataaaggttgagcaataaataaaatatgtttaaaagtaaatttcacttatgtaggttttaaatgaaatattaatgaatttgataaataatataacggttgtgtccatcatatcacgtagaatattaacaacataggtaaaagataaaaggaaaacaggggtgttttaagtgctaacttttgttaacttgttttgaagagaatggggtgatggtctgcttactttccaagaatagggttcccagtggtgttttcaaagagattgctgctacagattaattgtagggcccatatttgtgtgcgtgtgtgcacacacatgtacccatgaatgtgcctgtgtgagcacgtgtgcaattctatgcatgtacattcattcttttgtgtgtgcctgtgtgcatgtgtttgcgtggatgtggatgtgtgtttatgttcatacctgcctgggtgtctgctggaagactagagggcaatggctcctaaagacttttaattatcttgaaacctttctcccaaattttgtgtgaaagccaagatgatgcatttttattatgtttattagaaaataaatatacaactatatatttcttacttatttaagaacgttctcataaaggaaaaccttaaagttctcagatggtctctataaccttggcctattttataggtttgtggaagggacaactgacttagagaggctatggagatacaaaataacaccaatggttttgcagatagaaaagcacctcttctgaaagaataaggaatacacccagcctgtggaagccagaaccagcgcctttactttcataattcaaagtgggggcgagattcttctcatgtaactgaactgtagtattaatgatacaaagagatggaggtcgtatcctagctttcgagtaaatgccaacacaagcaagtgtgtctgcacatgcacacacacagtcacatgtgcaactaaaaccagtgctttttcctgctttgtgttatgggcttatgagccctgcatccagcagtgaaatgggtaaacagatgcatggcacatttgcaggaatacattccatgtaactgttggcaggctgcaccccttctgtgtcttctgtttatgtcagttgatacatctttaagaagggggaaatggaaggagcaaggaattgttggcaaacagcactgttaatcaggaggtattttatgacccagcaactctcagggggtttttaaagttcagaggctcatgaagagacatgtgtaaaggtccctcccaggggagacgaacagacactaattgaggtattgacggctctaaatgaagcagaaacctgctagaagattcagctccaaggaagatgagtgctgccaagcagtgcatgctgggggccttagcaggtttcattcactgctccttcatgcaagtaagtgtactcttgggcctggtgcagtggctcatgcctgtaatcccagcactttgggaggccaaggcaggcagatcatctgaggtcaggagttcgagaccagaccggccaacatggcaaaaccccatctctactaaaaatacaaaaattaactgggcatggtgatggtagcctgtaatcccagctactcaggaggctgaggcaggagaatcgcttaaacccgggagatggaggttgcagtgagctgagattgcaccattgcactccagcttgggtgacagagcaagactctatctcaaaaaaaaaaaaaaaaaaaagtgttctcttgaacacagaaacttgtgcctctcacagcacaaggtcccaagctaaagagccacaaaaaatgatctgttgaagtattaaaaatatctccttgatcatgtccccaattctttgcctcggtgaatattatattgtatatttccccatatgcacatataaaacaggcatataagatatttaagcatgtttcaaaaacattcaaggatagtaaataatgtttaaaagcatcacctatagtttctcctgaagaaagattgttgcactgctctctccatcccatttagggaggatttatgcaataagtattggaggttttaccacatttggccttttatattcgacatggaactatctcacccacagaggctttttggcattggcagcagcacctgcttcctcttagagagcctgggatgcccaaagcagagggaactgtgaaatctgacacaacgtgtaacctgtgctctaactgtatctctctgaactccacccagttctaaggatagtaatgtcagtgcgtctaggtaaagagacctttgaacacccgtgtgagtctgtgtgtgcctgtgtgaatagcaaatgagctgtcaccagaataccttcatcccagtaggtgtgtccctaatgacaggaacaggatgtgaggatgaatccactggaaactgctggggaaaagcacctgaggccaggggtcaaggaggcagctctgggtagcagagcagaggctgtgagcatcctctggagggcatgttagcacacgggggtaggcccgacctgtggagctgactcagtgggtctaggggggactccagaggctgcacattctacatgttcctgaggtacaatggtacagctgggtaggtggtggaggagggcacacattgagacccagtgagaggaatgggtgcctccagcatcaaccatatttcctgggccatttccacatagctatttggatgtgttatatcaagtaagttaaaactctgcttttattttttaaaaatcccaataatgtggtagtaaacatttctaatccttgcttttcctgggatttgccaaaaaaaaaaaaaaatgttcaaaagaagcctgggcaacatagcaagaccccatctctacaaaaataaaataataaataactgagcatggtagcacatgactgtagtcccagctagctgggggactgaggtgggaggaccccttgggcccaacaggtcaaggctgcagtgaactctgttcatgccactgcattccagcctgggcagcagaacaagactttgtctcaaaacaaaacaaaaacaatttaaagaaaatttaggtgatttattttccatttcaagaaaagaaagacattgcatgcatgataccccaggatagaaaccacaaagatagtgcttagcagatttgacaatgcatcctgctaaagattctgtatggcaataaacatgcaaacaaataaatatggaaaacaaaatttttaaaaagtcaaaccgaaaaaaaattgtaactatagtaaaaaagtattattatgcaataacataaatttataaatactaaaaacaatcccagaaaaagtgaaaaaggatagagaattcattaaacaaatggaaatttcaatattaaaataccaagatattcaaattctttctataatttctttaatttctgtgaaattttcttgccattgcagagcagatgactgaaagtgtccagtttggtaggaggtggggactggggtgctggcactctagtcttgcaatggaaatgtctgatggtacagtcttctgggaagccagtttggccaggtgtaaaaatatgttgtgtgagcagatcttttgaccctgtaattccttttcttgtattttatcctaggaaattaattagataaatgtgcatagtttatgtataaggatggctcattgcaatcttattgattataggagcctttaggcacaacataaatgttcacagttacttaaaaagtaattacacatctataagtggcatattattcagcccctaaaacacaaaaactataatgtaaagtctcagaaagatagatctgtgttcatttgctaggtctgccataataaattatcatggattggcctcaataataggactttattatctcacagtcctggaggctcgaggtccaagaccaagttgttgacagggttgattcctcctgaggcctctctccgtggcttgcagataaccatcttcacctggggtcctcacacggtcactcctccatgtgtgtggctacacgctaacctcttcttagaaggacaccagtcagattagatgagaactacccttaggacctaattttaccttaatcacctctttaagcctctatcttcaaatacagtcacagcaggagttgcggcttcaacatgcgaattttagggggagacacaagttagttcctaataatacctataatacattatcaatggaataaaaatggaatccatggagtaatagatttagtgtatgttcccatcaacaaatattcctggttcaaatttgagcagcactggccaggcatggtggctcttatctgtaatcccagcactttgggaggctgaggtgggtggatcacctgaggtcaagagtttgagactagcctggccaacatggtgaaacctgatctctactaaaaatgcaaaaaattagctgggtgtggtggtgggtgcctgtaatcccagctacctgggaggctgaggcatgagaatagctcgagcctgggaagcagacactgcagtgagctgagattgcgccattgcactccagcctgggcaacacatttctgggctaaaccgggccacaattccattgtcacagaaagtggcagcgaatctcaaagggttttcggttgagcatggagaatggctcactgagctgttgctttcattgttttccccaaggatcttggagtgctgcatgctctcatattctcacatggtcaggagttcttactcaccaggaaacagctggggaaagaagtaacatgtcctctctaacttacatgtgaaggaacattttgagtatgacgagaacatgcagaaagatctcctgacataactgttatccgtagggggttccatttagccctacacaaaatccccttgggttgcgaaacagaaatatggagaggcagctgcggctttcactgccctactcctccctcctcttaacctttcatttaaaaatctaaaacaggccaatctgatcctctaggaagattaagaaatttttgctggcaataggaagcatgcaactaaggaaaaagccctcaaaacaaacagcccctcaaagatgaggtctgagctattgtgatttcttttcagaagctctaagagcaagacagctgacagctaaatgagcgggcactattttgagaactcgcattcaggattaattgtaggggtgaggttctgtgggctcagagaggctgcctgtagccacgaggacaatgagtgattctcccctcatcgtcttccacttgggactctcagagctggttgccatggttgatgaagtgaagtgcacatgcttccgccttgatgacagtgagtgacaggaggttgttaaggaagcagtgggggaggatgagtgagaaggttatgcagggtgtgtggccaaccctggacctgtccagtataatgccaggctttgagcaaaatgccaagaagaagactggatgaagtgagaaactactcatttcatagacgttgcatggcgatgcctgcacacacaagactcctacatttctgttcttcctcttctgctctcttttccactcttacccttgctgatctgacctgcttgggctgtctcgattatttcttataaagccctgaccactctctcctgagctgctgtctcccatctctggaggtcagccaggtacttccatttggaaggcacaccatccccttacaatcaacatgagacagatgaaatgtggcacctttccttccaagctttctccctgtccctattcctgtcccaggctcctccttggatggattccaggtccccaaggcaatcagtggcctggtccttcttggtcaaggttcatagcatcatttaaattagacttgtcccctctaggcccgtgaccatcagcttactgcaagccataatcaggatgcctgtgctgggctgtgaaatggcattataactcatcgctcattcatcttccttttccactccagtctatcctagggctctgccagactcagcttcctcacatgcaacttccagtatgatatcctctcacttgcaatttacaatgtcttcctgctatttacagattaagctcagttttcacagcttaaaagttaagacgttttataatcttgctgcaacctatgtttccagttacccactaactccttctttacccagacattccaccccagcactcaaacataccttgtatgtttctccacctcccccattccctattttgaggtctgagaacatggttttccttttccaggtatgactggctggcactgttttgccattctgaaaattacctccagttcttcaagttggatttcattccaccttccaggttaaactcacgtcctacctcctctatggagccctccctgacctcacccctacaaggggctctcccttctccaaactcccacaactttttaatgtatatattcacatttattgcacatatatatcttttggcatttacttttacaaagctaaagttttgcaatacagactcctaggaagttgcaaaaatagtagagtcctgtgtgtcctttagcttctggccatgttgtgaatttccatagctgtggtgcaatatcagagccaggaaacccacatgggaacattcccagttaacattatccagtagactagatgccttcatcttttattcatttatttgttctttaagatggattctcgctctgtcacccaggctagagtgcagtggcacgatcttggctcactgcaacctctgcctcccaagttcaaatgattctcctgcctcagcctccccagtagctgggattacaggcatgtgccaccatgcttggctaatttttgtatttttagtggagatagggttccaccatgttggccaggctggtctcgaactcctgacctcaggtggtccatcctcctcagcctctcaaagtgctgggtttacaggcatgagccactgcacctggccaccttcattatttttaacccacattcatttgtgtgtatgtgctcgtgtagctctgtaggtgtatacttccgtttaactttatcccattacaggtccatgtacccaccaccaccatcaaatgaggaactattccacaccacagaagaattccttattcctatctgtctgtgtttgcacctggccccatcctacccattgtacctgtctactagtatccactaaggtattctccacctctgctgttttatcgttttgagaatgctttataaagataactttttgaagttggctttttttcactaagcgtaatgcccttcagactcatctaggttattgtgtgtgtcaacagttcatttcttttgattgctgaatagcagcattccaaactatggatggaccatagatttttcaaccattcacctgtgagaaacattcattttgttgttgttgttgttgctgtttgtccagaatttagctactataaagaaagctgctatggatatttttatataactttttgtgaacataaattcatatttctttgggataaatgcttaagagaacaattgctggaccacatggtaagtgcatgtttagttttatgagaaactgccaaagagttttccagaatgtctgcaccatattacatacccaccagcaatgcatgagagatccagtttctccacatctttgccagcatgtggcgttataatttttaaaaaatttttgttgttctcataaatgtgtagccaggcatgcatttttgatgtgtagacctatccacctatccatcagggcatgagtcaaacatttccaaaggcagtgacttgtccttggtacagcccatgatgcatcagacatgtagattctcaccaaaatacctatggaccaactgccttctatctagaagtgttatcacactttccactgcatactctgctaataggcacttttatccacacctcattattctcctccatcattgccctctggattgtaaactgcttgaggttaaagatgatgtcttaattgtgtagaccctaattgttggcaaatagtagctgctacacaaatttgtgtgtgtgtgggttttgttgtgggagactgaaattctgaagcttttttttttttggtgtggggggtgggagggagtcttgctctgttgcccaggctggagttcagtggcccaatctctgctctctgcagcttccgcctcccaggttcaagcatttctcctgcctcagcctcccaagtagctgggattataggcgtgcaccaccacgcctggctaatttttttatttttagtagagacagggtttctctgtgttggccaggctgatctcgaattcctgacctcatgatctgcctgcctcggcctcccaaagtgctgggattataggcgtgagccactgtgcccagtcaattctgcaactttttttattgcaaagaaggaagggtgctcaaggcatagagaacaacacagaggcctcaccttgagaggcatagccatggggtttagattgaacatgaatttagttttgatacttaagaattctaacttcatgttcaatctaaacaccatggcagccctggtctcagccttacctctgcagtctagttgtcgcttggacagtacatcctttcccagtaacgagatgacacacccctgtgcatatttcaggctgctttctatcttgtttttcaccattctcacaccaagaacaccaaggtttgtgaggcctctgttgtatattgtgacaaagagcaatttatatggttggcaataaagcaggttttttaggggttgatatttttcagtttaattttcatccctttagtgggttgaattgtggtccttcaaaaatatatcaacatcccaacccctggaatctcagaatatgaccttacttggaaatacagtctttgcagagttaaagaaagtaagaacctctagataaggtcatccttcattagggtgggtcctaaatccactgaagaatgtcatataagagacagaaaaggagaaggcacagagacacaaaaaagaagccatgtgaaggtggaggcagagactggagtgaggcagccacaggctcagcagtgtgaagggttgaggaagcctctggaggctgggagaggtgaggaactgatgtgccctcagagcctccagaaggcaccagccctgctgacttcttgatttcagatgtctgtgagagaagaaacgtctgttgttttaagccactccatcgtggtcattttgcatggcagacctaagaaacggatgccatcttcaagatcatttgaacagtatagaaaaatgtatttcacaaaacttttacttattatttcacatttttaaacttcatattccacgttttgctttattttgggtatcaaggcttctagggcatattttaatcaccccagaagcatggacataataagacctggttaaagagtgcactgtgagtgagccatggggtgaaggatcctgctgctgcctcacagcctcctgcctccctgtgcacacataggtttactgtcaggactgtaatgaggtttgcatgaataaacagctttagaaacagctttcaagtttccaccaaaatacctgttaggaagtcttgtttccaccataattgctaattgcttacctacatgtgacctgggtatccataatgcagacatgagcaacacatgattgtagaaaattctaatttaaattattacatttttatttgggttccacgcagaaaacatcttaggcagccactgcagattatttctagaagcgaagggaaacctggcttggagatggagtgggtgagaagctagaagggaatctgttaaggatgccagggatggaggggttccttctccatgaaaataagtggagtcaaggaggaatccttgaggcagcctctccaagacatgcaggatcatgggttttgactaggggaattttacgatattctagtgcagggatataaggaggcaatgtccagggaacagggctcttcccccaaagacagaacccctgggtccctcatcctttccgcatcttctgctgtgtttggtatccaaggcccttggcccagccatttggagtccactcaaatccacacctacatggtgaggaataaagggagacaaactcattggagtcattgcccccatagagcttcctttcctagacagacggaaacccagcaaacacacgaagcgagacatcaggcaatgagtgatacctgggtgtagagaacaaggcatcccttctattcttgctcctaaggatttcaggtagtttgttgcccagcccacttaggctataaatgctgctttctctccaactagtcatagctatcagccagcctggccactttggaaataagaatatttaatgcactcatggacgtgggagcctgtgttctaagacattcttactcagtcatagttagctgagactctaaagagtggcatatgtaatcaagataaaatatgaagtgtgcatctggtatattttggagcctataaagaaagattctgtgctgataatatttacattgggtttttcttgttgttttgtttttccaagatgatggaatataggcattgttagcattccttttccacttggaaagataaaatagtgtgtagagattcacactgtgaacttttttccaagaaggaacacaggaccgtaaacagctttgaaagaagctgtgagtagcagcctacaccgctgtctttgggaaacaccactgaacatgtaaggattcttatagactacaggtaaagggtggaaaaagagatttccagcaaatggaagccaaaaacaaggagtagcgattctgatatcaaataaaacggacttcaaagcaacaacagcaaaaaaaaaaaaaaaaacaaaacaaaaaacaacaagaaaaagacaaaggtcactatataatgataaaatgaccaattaaacaagaagatgtaacaattgtaaatatatatgcatcaaactccagagttcctaagttcttgaagcaatcagtatatcaaaaagacacctgtacacatgtttatcacagcacaattcacaactgtaaagatatggaatcctcacgcctgtaatcccagcactttgggaggccgaggcgggtggatcacgaggtcaggagatcgagaccatcctggctaacaaggtgaaaccccgtctctactaaaagtacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaagatatggaatcaacctgagtcctcatcaatccatgaatggataaagaaaatgtggttcatacacaacttacccatgtaaaaaacctgtacgtgtaccctctgagcctaaaataacagttggaaaggaaaaaaatcataaaagcaagactcaactaaaaaaaaacaaaaagaaaaaattgtgatatatataccatgaaatgcaacccagccataaaaaaaaatataatgacttttatagcaacttggatgaaactgggggccgttattctaagtgaagtaactcaggaattaaaaaccaggtactcatgctctcacttataagtgggagctaagctataggtatgccaaggcattcagagtggtgtaatggacattggagactcagaagtggggagggaggtgaggaatgaaaaactagcagttgggtaaatgtatactatttgggtgatgcgtgcactaaaatcctagacttcaccactacacgattcatccacgtaaccaaaaaccacttgtaccattaaaactaatgaaagaaaaaaattaactaattaatttaaaaaccacactggggagtccctgcatgctaagtaggtagaacaaatcaatcataaatgactgccattttgtctacattctgtataaaaaaggtgaaactgctccttttcttctcctttaaaaaaaaaaaaaaacaactttggtatttgtgctcaagactactatgggaaggacccagttataaacatgcatttcacgccaatatttcttcttcagaataagtgctaagcaagtcaagacatgcaatgatttcttttggcctcctataaaacaaatgagccctttttgttttgtatttgttttagagacaggatctctctgtcacccaggctggtgtgcaagatcatagctcactgcaacctcaaactcctgggctcaagtgatcctcccacctcagccgtctgcccaagtagctaagactacagtcatgtgtcagcatgcctgcctaatttaaaaaaaaaatttttttttttttagaaacagagtttcaatatgttgcccaggctggtctttaacttatggcctcaagtgatccttccacctcggcctcccaaagctctgggatttcaggcatgaacaactacacccagccaatgatccatttttttatgaaatttatattaaactggttgctttataaaaaaagcttttaaaaacctctagaggcaaagtccgtctattttagaatcttgatagaaatcataggcttatctacatggatatctataatcaacacctattaatgcatcatcagttacaaaaccaaagtgagaactgtgagtataggaaaatgtcaatactgtttaaactagatttatgcaaccacaaggaatatcacttaaattgttcatcatagagcagattttgcacctggcagatgagactgttgtcacagcagcacaggtaacacccagcagtaaggccaggaggcccctcccgcagccaaccagtgcccccatgagaaggcagccactgccctacctcccccctggagctgctgccctgttagaatgtgatggaacagacaggacaccttggcagggctaagtgaccaatgtcttttcttggccgagaatctcatgtcatttgcattatttttcaaagtcggtcaccctaagtagaaaacaaagatggctgtgtctgaaaaactgaacacaactaatgattccattcccaggccagaaaagggaccagtggacagatttctctcctcaaactctaaaacacaacctggctttctaaaagagaatatctgttatccctttctcaaaaatgccatgacaaagattttcatcatttcaagattattttatatttgaagtctcagaagactatgtatatatcttattattgtattacatttcttgattatatttttctgattgcaaatgaatagaagcttaatgcagaaggtttgaaaaatgcagaaaagtataaaaaagcatagaaagatatcattcataattgtaatactgagagaagcaaccattttaacaagcacattttcttctatctaaaaagatatgatttctgagccttgtcaacataatactacatatatgtatacatatacttttcaaacgtcctgctttttttaacttttattttaggtttggggtacatgtgaaggtttagttacataggtaaacttgtgttatgggggtttgttgtatagattatttcactgctcaggtattaagcccagtacccaatagttgtcttttctgctcctctccctcctctgactctccccactcaagtcttccacaatgactgaactaatttacacttccaccaatagtgtataagcattcctttttctccacaacctctccagcatgtgttatttttatactttttaataataaaattattaaagtcattctgactggtgtgagatgatatctcattgtggttttgatttgcatttctctaatgatcagtgatatcgagatttttttatatgcttgttggccacatatatgtcttcttttgagaagtgtctgttcacgtcctttgcccactttttaatggggtggtttgtttttttcttgtaaatttgcttaagttcctgattattagacctttaccagatgcatagttttcaaatattttctcccattctgtaggttgtttactctgttgatcatttcttttgctatgcagaagctctgaagtttaattagcttccacttgtcaaattttgcttgtgttgcaattgcttttggtatctttttcatgaaatctttgccattcctgtgtccaggatggtattgcctaggttgtcttccagggtttttatggttttgggttttacgtctttaatctttcttgagttgatttttgtacatgttgtaagaaaggggtccagcttcaatcttctgcatatggtcagccagttatcctagcaccatttcttgaatagggagtcttttccccactgcttgtttttgtcagctttatcaatgctaagatgattgtagatgtgtgaccttatttctgggctctctattgtgttccattggacgatgagcctgtttttgtaccattaccatggtattttggttgctgtaaccctgtagtagagtttgaagttgggtaacgcgatgcttccagctttgttctttttgcttaagattgctttggctttcaggccctttttttggttccatatgaatttcaaaaatttttttctagttctgtgaagaatgtcatttgtagtttgatagctatagcactgaatctgtgaattgattttggcagtaccattttaatgatattgattcttcctatacatgagcttgggattttttttttcacttgtttgtgtcttccctgatttctttcagtagtgttctgtaattcttgttgtagagatctttcacctccctggttagctggtatttttagaaatgttattctttttgtggctgtgaatgggattgcctttctaatttggctcttagtttggctgttgttggtatataggaattagtgatttttgtacattgattttgtatcctgaaactttgctgaagttgtttatcagctgaagaatcttttgggctgagactatgaagttctctacatatagaatcatgtcatctggtttgacttcctctcttcctatttggatgccctttatttccttctctttcctgattgctctagctaggactttcaatagtatgttgaacaggagcagtgagagagggcatcctcgtcttgtgccggtttttaaggtgaatgcttccagcttttgcccattccatatgatattggctgtgggtttgtcatatatagctcttattattttaaggtatgttccttcaatacctagtttattgagagttttgaaatggaatgagtgttgaattttatcaaaagcctttcctgcatctattgagataatcctgtggcttttgtctttagttatgtttatgtgataaatcacatttattgattgtgtatgttgaatcaaccttgcatcctggagataaagcctacttgatcatggtggtcaaatcctgctttttaaaaatgcagctatattatacgactgcctcctatattaagaaaacttatttaaacccataatttaaaattaccacataatattgaattaggctgatgcaccaccattcacagaagcagtcacttcattaagctatttagagagaaacaattttttattattttaaagttctgtcttgactctttctacataaatatttgtctataacttttatttctttggtatagataattaagggtgaaattaatgagtcaaaagacattaactgtctttggcttttgatatattttgtcaaattgctttaaaaaattttcctgccaaatgatatatcagaatgtaaatatttgtgcatctctgccaatattccatattatcatttattttgtttctctatatgtttattaataaaaccaataaccaacaagtgaagttaaatgaatttttttgagtagcattctacttcataaatgtttgtaaattaatacaaatgccaacaggtagaaatcttacatatgtttacttttgttatatatacaccaaatagcatttttgaatatgtttggtgcagttcagacataaatattctatacttccataaaagatactaaatagctgtggacaaaaagaaaacgggaatcaaggctatctaaggagttaatggcttaactttttctaacaaacagctgtaaactgttttcaacgttttgccaggttagatttgatctttggttttaactgtgttatgggagccttagcaatataaaactgcctttcaacatgacatcctgtctctctcacatccactgtggcctggggtcctggaagcaggctttgggaagatgtgagcaccttgtgtacacttgagggagagtcattgtctgtgtgtggccagctacctctttctccatgaaccaacctcgagtggctatttccaaacgtagccaagtcaagcattagaagagtttcatttaaagtgaatatacatgtctgacttaataaataaaatgtagaaggaaaatacagaatggactgtacaacaaaatattcactgaattcactattttgtctcctctgaaaacattctgtatttgtaagaataaccttagcctgggttttgaggttaagacatttggtattcaagagataaattagcttatcccactttttaattaaaatggttttcctccatggtacataaatagactataaagaaatttgatgttatgcaaactctgctatgataaactctaacactgtataatctttaataaaaagtctccacaattttggtgccacacagtgatgaggatgtattagaatagctatatgagactccccatgagagttcacagcttaactgtgactgaagaaacagatgcaggacacaatttatttccttgtattccaaggtggatagaggtattgtgcatgtgtgaaaagcggtaggaaatgcagcaggctcaccctagcacccaaccaaaaggtggtcatttatccttctgcgctcatcactgtgctcactgggccacgaggctgcacaagcttacttttacaacgtgttgtctgaggtcactccatcaatggaggttttaatttcattaatctctgaaccatcctaggaggtagctttgtattatctccatttcacagatgcagaaactgaggctcagaggtgctcagaaacctgctacaattcacatggctagtgagaagcaaagtaaggatttaaattcatttttgcctgactatagtacctctgtttattattatgcaagagttgtggagtgtcaaacaggatgaaaaagagttgagagcctcaaagagttgagtagagtgaaaccatgaataatagacggatctctcccagaactacactacctgtcccacccatgccaccaccacactacccagcctgcagagggcattacaatcagacacctgattggattactcagatccaagatctagataacctgaaaaattatttcatatgtatatttatatgtataataatgtgtacgtgtataatacatatatgtataatatataaatatataatatacatacgtaataggattattatataaataacataaaatatatatgatatgcataatataaaataatacatattatatataatatacatataaatagtaatcataagattgttttgtatcaactgatctcaggtacagtccaacaacacctgggatccctgatactttttcaaaggatctgtgagatcagagctattttcagaataacactaaaaaattatttgcctttttagccaacagtacaaaagcaacagtgggcaaatctgctggggccttaataggattcaaggcagtggcaccaaactcttctcacggccgttgtggtcttcacaattgtccgtcaacactcgcaacaaaaacaaacgtggcagcttcacttcagcatgtccttgactaagcagtggaaatcatttcatttcattccatctcaaccattgagggtgtgcgtttttaacattctgtgtgacagaatggcagaaacatacaaagcacctgtgtgttgggtgctcaagaaaagctccagtgtgggactgaatatgagctgatcagctgtgattttcatggaacacatttctacttgaaagaaaaactgataaactatttttgtctgggtatttgacaaacattttctcaaaaggaatgaagtgagcctgtcacttcaagggaaacaactgagagtgtttgttgccagtggtaaaatttgagcttttaagtcttaattcgattttagaaaacttggattcttcaccacatgcttaacacaccttcccaatatttaaagatattttggatgacattagtagtgatattataaatgtgattttcaaaagtattgtataatggagtgcatcaacatttggaacgtctacattactaagtgaataaatactttccaaaaaccaatgcatggtgttataaaatcatgcatgtgtaaaagatccagaaacactgatatattttaatgcaatagggtaggaaaaggctgttgatatggtttttggttctgcatgggaattaatctttaaaaaccaccgcttgccaaattttggtagagtatcaaagagcaatagccatgatgatctgaaaatgctattaagcttccctgtccaactacacctctgtgcgaattgtattttcttcatatgcttcaacgaacataacacatcacagtagattgaatgcagaagcagctacaagccagacttcagagattttcaaaaaatgtaaaataattcatcctcttctcaccaatttctaaaaatagtttattaagaagtatatttatgataatatgtcatagttgtcatttaaaaaaatatctcagtgtaatctctagtacagcaaatattgatagatccaacccacagaaacaaaagccctttggaatcttcaagaatttttaagattataaagtggtcctaggatcaaaaatcttgagaagtgtccttctatataattgagacaattttaaagtttgaaatctatactgatctgtattaaagatctaaagtctaatggaagtttcttagaatgagggccaaatctgcaaatataataaactttaatccctggaaatgttctttgctcaatattcttttacccatgaccacgctcccctccagcatccctaccaacctttgttcccttctcaggtgtgtccggtgtggcctctctttcccctcctgacaccaggagacctgcccagcagcctgccctcagtccctgctcccgatgtgggagccaagaggaaggtgcaggattggagttgcctcctgagactcaccctcagagcagctttgaggaggtccccaggctgcagggccctgaaccccaggtaacacctgaacatggtccttagtcctgcaacccagagaccagcccatcacttgagcctgagagcccccattcaagtcatttctgagccacgttgaacttgccatcatcaccgctttcattccagctgctactatcctaagggaaatgccattttcagctcttaaacacattcttttcttgcagcatgacatatgggcttcctaaacacaggtaaaaaaagctccaataggaagacagcttttctcagaaccagaagagtatttttaaacatctttaacgaaaatctaagttaccttttttttctacagtcatatcatatatacacattataattagaaacacacatgctcagacacatccatgtatctatctaaatagatttttttgtcttttaagtcatcaatagcggttgttaacatgatctaataaaatgcctaggctatatttcaatgtgaaattgttaaaagttacaacattaataaaaagttgctctcattcacttatgaaggttagaatggtttctgagtatgagaatgacaacacttatgtgaacacatttaatggcctctctaaaacagagagggtgctcaaaaatgccctctcatatttcccacctgcccagataggcccatgtgatggttgcctccatcaggaaggatggagagcttctggaaacccctaccccaccccacatgctgtgggtccctggggaatgcacttgcatttcctagatttcagagaagtgaagaatgaatgaaatcaggatgaagcaaaatgaatttctcaaaataacccacagtgtcataacaatgtatgtactagggaattgagaaaaccttcggctaggtataaaaatggggattttttaactgaaaaagaatttttgaactctttaaatatcctatgattcagtctatttttctcccccaagaaatcaaagcagtataatctttcattaactggttgattatcactcatgcatcattgaacaccaacactatttcaaacaagatctggttaaattgcaaatgagaataaatctggtgataaatggatatcatatttaatatttaaatgtctctggtatttacacatctctggtagttttgttcttagtcaattgtttaagtgaatgttgagaagaaatgaaagaaagatgtttgctcctctttgaaaacaattacggtttccttgcaggaatatgcttatctttcacatttcatcagaaacataagaagtctggctagaggcaatgacactgatgggaagagctctatgatggggaaagactgcttgggaaatgcagccttctactatatacactaaaattatcaataacgttgcaaaaagagaattcaattccataaactaatattgatgcacaaatgagcaaaaatcaacaattggcaataaatgacatcttaaatctgcatttgaagattttacaatagtcaaaaataaacataaaaatttgctttcatattttctaaaatgagtatcagagacactgcatcctctcaaatgacagctattgggacaaccatctctaaggctacatcttacgtttcatatttatatgccagtgaatattcaagttaaaaaggacacttcaaaaaagataacaagtccatgttttgtcctaaattgaattgtcggtcacctgaacattcaatcccacatgtagttggctctatggactcttgataaaaatgtaagttggtttgaattagaaactaccttttcaaggaggtactgtgcatgctacaaggtgaagcacatgacactcacacgaggtacacacaccatacactcaggttgtgtactggtaaacactgaaacatccctgttcacaggagattggccaggccaactgcatgaaagacactgcccattctcagactcagatcctcctgccaacaaggtaagcctgtgaatgatagatgagtgtacacatatgcgtacttgtatttcccttctctttactgcctgccttcatttctgtttacaagacctgccccaaccacttgaccttgaccatcatttcacggctgcaccttgccctttggaccaagcccatgacatctgccttgtgtttagaagctcattgccatcccagcctcttcccccagcgatctcaggcacagcctctcaaaaccccttacccacattcattcccactcaaatactctacaatttgtaattttcccaccttcaacctttaagccttctctatcttcaaaacggctaaaatcctgccagatatgaaagaagccatgacatcttctcctccacccttctttgtgtgtggactcaacagtgccctcctggatccctcatccaggaggttgagggattaagaggccccgccatccatcctgagatagtgcagaccttgttgataaacgtctctatattcccggaggccagttgcttccctatccctacctattaccgctggggtccacacgatctttgttgggaccatggagagaacacaaaggtaacaatacttttccccaggcctcagagcctcgatttgtgtgaactaaggggagaagaaagtagagggcagagaaagtccccctgtcctccaacaccttcttggaatcagacacaagtgtgttggtgatgctccaccattgaccaagatcccagaaccatcactacattgatatattttcacactgaaaggcaatgattccaacatgaaaatatctattcccttatgggtttgataaagactttctacatataaatagcacttatttacgaactgctttacatgcattaactcttgcacgtccacttatctatccaatgagatgtgttctcttatgatccctgttgtacaattggagaaactaaggctggaagagatggagttagtacatcgcagagctgggatacaaagccagacagtctggccctcagaacctgtgctcttgactttctccccaaatggtagtgaactctgcaataaggaacatagataagatgcacagaaagtttggtgacaatgtgcggacacaaatgtggaacacatagttttatttattacttggtagacaattctttgtaattcagtgggttctcggattttcttggattgaaacagaaatttctcccttgaacactgagttgataatagctcagttcacttccttgcatttctttaggggtgctattttaatgtcgggagagatatcaagcagcagaagagattctatattaaaatgatattttctatttggctacgaaatgaaagaaatatagatacggacaagagctaagtgaggaggcctggtggcaacaaaatgtcccaaacccatgcagccctccacaaagacctcattgtgtcaggctgtaacaaatgaacccaaagtcattctctaatgtttagagacctctttcaagaacagcaatatagatctttaaccaatccaaaagttaatttgccatttatgttgtttatacttcagcaattatttaacattttttaaaatttttattttaagttcaggggtacaagtgcacatttattatgcaggtaaacttgtgtcacgggggtttgttgtacaaattatttcattatccaggtattaagcctagtacccgttagttacttttcctgattctctccctcctcccaccatccaccctccaaaaggctccagtgtgtcttgttactctctctgtgtccatgcgttctcctcatatagttcccacttgtaagtgagaacatgtagtatttgttttctgtccctccgttagtttgctaaggataatggtctccagctccatccatgtccctgcaaaggacatgatctcattctgctttatagctgcatagtatttcatgatatatgtaccacattttctttagtagtttcttaggctctaggaggaaaaaaaaatcatttaaggatcaaagactgatgctgggataaaatgtgtcatggttgactctggcccattctgaagccacattcctgagaattcagcactaaagcatttggaaggcttcgagcttttccagaagacaggtgcatcctgtgagaatcacagcacaatgactcagcctcccagctgccaccttcctgaagatagaacagggcaggcatcttatggcatgttaaccaactctttggaaaagggtcatttttgtggcctgtcacaagactgaggctgataggaaatgctactttaccaatagtagacaacatttggggtaaattgttttctaaaggcctagcagctgtctcaagttcttcccatgatatttctcagaatttgaaatgtgatgactctgtcttaagatcatacaggtattttgaggtctgtagctacagagtaccacccctttcccccactgctacccttactggtacacctgggaggatacctgctcttctatttggtttttcaaagtaataagcaacattttagaatacatttagatttatagaaaagttgagataataacacaggaagtccccatatacttcacatctccacatccagttcctccattatttacaccttacattagtgtggcacgtttgttacaattattgaatgactattaatgcattgttaactaagtgcatacattgttcagatgaccctacctgctacctaatgtccctggtttgtttcaagatcccatccaggatcccattctacattctgccatcatgtcttcttaagctcctctgtagcagtttctcagactttctgtgttcttgatgactgtcagtcttgaggaatgctggtcaggaattatgtagaatacctctcagttggggcttgtctgttgtttttctcatttttaggctgaggttatgagagttttgaaggggcaaactacggaggtaaagtaccattctcatcacatcatatcaagggtaaatgctatcaacagggcttatcagtgtcgctgttgaccttggccacctggctaaggtggtgcctgccaggtttctccactggaaagcttctctttccatgtcgtcctttctggaaggaagtcgctctgcaaagcccacacataaggagtgagagttatgcttcatcttcttgaggtggtatatctacataaattacttggaattctttcgtcaggaaaatttggctattgttaccatttattcaatcatttatatcagtgtgggcttattttacacttatcacttattttacactgatacacttatcagggtgtatttattttaaactttgggttataatccaataccgccttatttgttctgttgctcaaatgattccagatttaaccactgggaactccttcaggtggctcccacatcctattgatgtatcaccatcattgcttgtttattttatcctttctttccccctccacctcttttcttttttttttttttcttggtacttctttattttctaactctacaagaagttccaagtgcttggaagttccaagttcttttatattcccttaccagtcttagaattagcgttctcaaaggagtcctggttcattttattggaaaatcctattagaaaccaagatttggggacagttgtgtttattgctactgtggcattgttccttgcttccaggttctcttagctgacagaaaaaaaaatgtgtgtatactaacacatgtatatacacacatctatgaatattcctgtatgtatccattgtatctctattcagctaaacatgagttcgtactgatgtctctaagtctaatcaggtaccacacagctcattctagcctcttccctagcttgtttgtaaactcccacttcatggtgagaaacccaactcccatgatctgccacccagggccctaattgtttaattacagtttagatgtatagtagtttcagaagtaagtccctgttagaaacaactttgtcaaccagagtgcaatgtttaggtatagttctttttgcctttagtcatacagcttccattcatctccaaagttacttaggtcagcatccaattagtaaagttatttaactcatttgtaatacaattagattgatttgcacagtctccatttcatcctggggtcccatgacctcttaaatgctttttttgaaaattttaattacattttaattcacctacattaagattcattctttttgctggaaggctctgtggttttgacaaatacatggtgttacatattcatggttgcattatcatacataatatcctcaactccctaaaaatgtcctgcatgcttcacctgttcagtcctctcctttccccaaatccctaacaaccactgatctgcttctgaactctattgttttgcctttttcagaatgtcataaaaatggagtcatagagtatccagccttcttagactggcttctttcccttaatatgcacttaattttagtggtttgactcatcattctactttatagctgaataatattctactgtcgagagatgtaccaaacaaaagtttgtatttattcatcagttgaagcacagcttgattggttccaaatttttggcaattacgaacaaagctgttataaacattgatatgcagatttttatgtggacatacatttttacatcagttgggcaaacacccaggtgtacaattgctggatcctaagacaacactgtatttagttttgtaagaaactgtcgagctggctctatacttctgcatgcccaccagcaatgaatgagagttgctattacttaatatccttgtcagcaattgatactatcagatctttggattttaactattctaatagatgcacagtactatttcaaggtcattttaacttgcatattcctaatgataaataatagcgagcatctttttctatacttgtcatcatatgttcataagaaataatggtacaaagttttcttttcttgcaatgtttttatttctcatattagaataatgctagactaatggaatgggtgaagaagtgttctatctgcttttgttttctgtaagactgtggagcattggtattagttcttctttaaatgtttgttagaattaccagtgaagcaatctgaacattgtgctctgtttttgtttttgaaaggtttaaaattatttattcaattattttaatagaaatcggactattcagtttatcagtttctctttgcttaacttctggaattggccaattttatctgaataatcaaatctgtgagcactgaccttttaaagtcgatgggaccagtcatagtggcccctcttttatttctttctctagttttctcaggtgtagacttaggtttttgatctgagatctttcttctttttgaatatatggatttattgctatacattttactctaaacactgcttttgctgcaaaccacacattttaataagtatttttatttttacttagttaaaaatattgttcaatttttcttgagacttctgctctgactcatgggataactgaagagtgtgttgtgttaattcccagatattagaggattttacagctatctttctgctattggctggcagtttgatttttttgtggtcataagttgtgagggttggggagtgttccatacttatgattaaatctcagtgttttttgggcctgtgtttcagggccgtgtccttccaagtgtctgcctctcttccaggtacacagatgtccccacaacccccacccggcatccctgctctgttctctggctgcagcatgcccaatccatttctctgaagccttgactctcgattatgcttttttttttttttcacaacttagatcatataggtaggctggagagggctggagtgggaaggaatttatttcttgcaggtgagacaaaatttcagaatgtggttctggaagaggttttttttttttttttttaaattttccgtggagagtagacctttgttatggagaaggtttgatcttcactgtgagaatctggtaaggttcctagagagaaagtctgtgaaagtgtgaggacgaccccaagacggtggcctttaggagctcctcactctcactccagtccacactcagccaccaacactgtaccaaaattgccatttgcttgttcttgctacttcactggcccagcagcttctgttccaggtaagccaatctctgttgttgtatctcgctgtgacacctatctccctagatttccgggtgagagtttatctctgtcaattcagttctctgtaagaaaacttgttgattttcagtttttccaggcttttcttttatttcttttttttttagacagtgtcttgctttgttgctcaggctggaatacagtggcatgatcacggctcactgtagcctctacctcctgcactcaagtgatcctcccacgtcagcctcccaagtagctggggttacaggagcacacgaccatgcccagctgactgttctattttttgtagagacaaggtcttgtcatgtttcccaggctggtctggaactcctgggctcaagtgatcctcctgtcttggcctcccaaagtgctgggattacaggagtgagccacccagcctggcctccagctttttcttgttgtaaagatgagaatgatggcctacaagctcttcatgtgtcagagctgaaattaaaagttaatgcctcctcttttgtgatcaaatattttatttaccaatctgatatatatttgagcagcacaatgagaaactggtctggacaccacccttggcattttaggtgattaatatttatcttacattctaggaatcatctaaatgttcccatatatctacttgaaaaatatcattgtttaccccacaatgaatatagtaattttttttggattttataaacagtgcatgtttacagaatggaattccactacttctgcattggcagacctagaactgtaactacaggcagatgacgtcactcattatgcactaagattgaattctatttctagttgcagccctgaagacaggagaaacaagagaaaaattcaaatatgaagaagccaaaaatggacttgttgagttaaatcaagaggcttagccacctgttatgggatggctggcttttgtgagttgccataagagacagataataaatgtatgaatctacggagcatggggtatgatagacccataggaaaagctttgatacagccctttgatacaccttagaacagacagggattgaattttacaaacaagatgctagtcagtgtctctacaagggacttctctggttattaagaaacctcagtccactaggaaaatatccctaaaggtgcccggaaagctactgcccaagctgtttgacatttcatgttttctcagtagataagtgtcttctacctccagaaagagttagaattccatacagagatgttttagagaagaagccccaagcattactatttttatggtaagaaatctgtgcagtttagctgtaatttttatgagatatagcatattagtatttatcatatttgtaattctaatttaaatatataattaagtaatcaatttagacaggtgatactaagcaggacttttactgagattaaacctagtagggtgatatttaaggagtcataataatactaagttattcatgttgtttatttatttataagttattaagatgcccagaacagttctgttagataattggagtatttaaaaaggaaattaaatatgtataatttataaatgtagtttaatatataaagaagaaaatgaactatgtttataaatgggtctaaacattaatcaaaaatctcttcacgtgagataacggagaggatcagaaaaaacacctattgggtattatgcttattatctgggtgatgaagtaatctgtacaccaaacccccgtgacgacagtttacctgtataacaaacctgcacatgtactcccgaacctaaaagttttttttaaaatcccttaagagtacttgtttaaatttacgagatacatacatagaataacaaaatttataagttgaactgaaaaagagggtttttacatttataactttaataaatgaccatattaaagtccaagtaatattttaaatatatttttttcttcactcaaaagcatctgcaggctccaaaaaactcacctaaacaaatatacttaaatctgatgaagaaaataaaggtcactaaaaattcaaccaaccagtctgaggcaattttggtcaaatttctactgaccatgcttcaatatgttcttatgtatgatacacacacacacaacacgtaatattgcacaagtggaaacacattacgtatgctgttgatataattagagactttttgcccctatgtccacctttctgtccttctcctccacatggacacactccctcatgctcatccctgccctctagtctttattaataacctggtgtatgccctttcatatttttctctgcaatcatacacacgcatgtacacacatacgcaattttttggttatagttcatttgacagaacggtatctactacacacaactcggcatttactttcccaagcagcaataactcatagcaattccacatgacctggtatcactccaattcacttctttttcatggctcagtaatagttcttgcatgttaagatggctccaggctgtatcaacatctgacagcctcaggtaaggtctgcacactccttcctgcctcgctttggctgttgaatgactcagttcattcagccagtctgtgcaaatctcagttcccaggctaatgatgcctgcagtccttcttaaccagaaggcccatgctgggaatgtacaacagctcttgtcacagagtgaacctgaagagctggctagcacggaacatggctgcattctcagaatattatatcggtcttaaaacagtgatttggttttcactttactcttgaggcatggaattactttttggacaacatggtgcctgggtcaaggtaaatttgagtaattctactaagaccatccaagttgtgaagatctacatagcgcagaagtcaactcgtctctggtacagaacagttctgcaactttggacaagtagtttaacatctctgagccacacagttgctttgcctgtaaaatggaaatcatggtcatgtccacttcagaggctgatgcaaggataaatgagattacataagcaaagcagttcccactgggcctggcacttgtaagaaaagatcattgtaagctattacgtgcttttccatacttggtaatgttgagtcaagatgtggctggttcttgaacttttgggaaataaggaatatgaaaattctgtgaccattctaactcctgtctattgtagcctcagcattctgtttcctgcttctcctctctgtctttgcctattctatgatgttcttgatccagttctctcttctctcacttttctgcagtcacatggtctctgtcattccttcctggtacatttaaatgcatccagttgccaattctttgggtggatatgtttctttttttctttttttgctgatagaacttcatgtaccctgaatgattcccctgggttgtttttcctaaaaatataatgtgagtaaaatatgtatccccgaagcccagggtagaggcaggtcacaggaggcttcttggtctccgtctagctccagatcttcgtaagcatatcagggcattatgacttagttgccctatgtctgcaatgatagcagaccttgttaataaaaatcactatcactatcagctcttcctcgtttgtatgaaactagcctcttcagaaatgcaatagtattaggagtaatttatttgcctgtgtaattaaagaatctactacactacatgcaagaaacaaaaattagcagagcaaatgtttatattattctatgaaaatagtgatacattacaatggagttatccaccttcagccctactgaggcattgggatatggtcagggggccagatggtgaccataaaatacaaagatgagactcaaaacagacagtggtttcatatcagttaaccgtatggtccagagtaaccatctgtactagcctctacaagaaacacattttgccttatgaagtaggaaaacacaagagaggaagctgtcaggttttcaaaatatggaggcatttattttctttcgctgtatgtttaatttgaagaatgttacataaaggccgataattaagactaagagagctgctacttcggtctgtgtagggctctttctgagctctttaatcaccctgtcccccttcagcaagagagctcagctgaaataatggaaaacagaatttagttctcaaggaccattcggaagaaagaaaatggcaccacacccatgagggccaaacactgccttccattcaaaatgtatcttctccaccccttaggatcacctgattcgacacttcttcaactgtattcatctgcaagcaaatttggcctcactcccaaggacattgcagctaggaagttaatgatgatgcatcaccaggcttgcattccttttcagaaaaaaaaaaaaatcaggtccctttacactgcaccaacagccatcatcattactgagagagctccgtcacattagatgcaataaacgtatgtttgtatcatcaacgggactaagaaaaaaagctcactgttgcatggataatttttctattattcaaaagtaaggttgttttgctaaaacaaaagttgccaaagccccaggtgatgaagtacaatgtggctgtattatcaagtaccatatcgagggtggaaacactgtgggttggaaataaatttcctctgtacacttgcttccatctgcacacttaaatatataaacttgtttctgccgatgcagctgcatgtattaaagaagaattctaaaccttgaacttagctgcccatgtttcttgcctgcattctagaaactgctttctgtgtataggtagcaggttgccttgctttgtatgatatgccaagcactgagcccagggtgtggcccaaagaggaaacttaatcaacatttgattaatgaataagtcaaaatatgcttctcaaagtgcccactctgaagagcatcggagctctggctcacgctcaccgtgttgtaaggtcaccatagcccagggcttctggctcttctctatctggtgggtctccgtggatgtgggctagtttatccttccaaaatctgtacagaacttccagttctgtagggtgttacttccagggtacaaatacatggggtaaggagctagatctcaggtgctgtagtcaaaggaaagaaacacccagccctcagacacagagcacatgacgggttttgagtgacaccaggggtcaggctgcccagactcacaacctggctctgcttcatagaagcctggggtcaactgagccctaggcattagttccctcatctttaaaatgaggttaataatagtactgaaatcattgtggaggaataattattaaatgagttaatatggataaacagcttgggaccatgactgatctacagtaagcagtcagtgtctacctaattacactcagataaccgaaacaaagatgtttcatcttactagtgtctgagaggaggctgccaatgtcaccaggcaaggcacatgaggagaacagtgcgagaagccatggacagctttattacttctgacaatgactgaacaactgtcttccaactctcccgtcaactcctgaaaggtaggtgtctagtgcccatcacacatcccagcgctagctcttcaacaattctgtggagactgttcagtccaggtttgctgaacaaacactgcaacaaagctaggaggttgtagacatttcctgtggctgctggaataagttctcactcttgaaataatgcacatttattctcttacagttttggagatgagaagtctgaactcaagggtgtcagcagggctgtattccttctggaggcactaaagaagtttattattattattatactttaagttctggggtacatgtggagaacatgcaggtttgttacataggtatatacatgccatggtggtttgctgcacccatcaacctgtcatctacattaggtatatctcctaatgctatccctcccctaggcccccaccctctgacaggccctggtgtgtgatgttcccctccctgtgtccatgtgttctcattgttcagctcccactgatgagtgagaacacgtggtgtttggttttctgttcttgtgttagtttgctgagaatgatggtttccagcttcatccatgtccctgcaaaggatataaactcatccttttttatggctgcatagtattccatggtgtatatgtgccacattttctttatcaagtctattactgatgggcatttgggttggttccaagtctttgctattgtgaacagtgctgcaataaacatacatgtgcatgtgtctttatagtagaataacttataatcctttgggtatgtacctagtaatgggattgctgggtcaaatggtatttctggttctagatccttgaggaatagccacactgtcttccaagtctcttaagggctgcctaaattccttggttcatggcctcttgcctctctgttatgaagatcctggtgatgacactgggcctgcctggctaatccagggtcatctctccatctcaagatctttcccttaatcacatctgcaaaggcattttgtcatgtaaagtaatacattcacagattccgtgggttgggctacagacatcctggggagggggtgtatagttttctgtctaccaaagagcttgtggaagattgggagaaaaattgaatcagatatggggatatgtgggaggaaatgaaggaaagatggccctccctggggtagaatctgaggattttttaaaccataatactccaaagaatcaactgggtgcctccaggaatagaaatataagactccagcccccaagtctgattctgtggtctggaaagtggaatgggaatctgcattcttagttagctctctcatctccagtgaaaacgacccttggacatatttggacaagcatactcaggatgtggcactccaggtggaggaactgaaaatgggccagactttggctcatgagaatctcctctttacacaataatccacagccaaaggctctgtgttttaaaaccagggaggtggtagagctggatagcttttggggacatctgggcctaacagcgagtaggagaggggatagaggtgttcaccgctaaactccacctagcaggtatgttggcctaggtgtcctctcagaaggaggaagacagagacaaccaagcgctctgagtggaaagcattgcgtcttctctcacatgtgccatagcagctgggggaaaagaaaatgactaatttgtgtgttgcctaaataagcaacaccatccagaagcatctctttccttttccatgcctaaaccatgtctaagtaccggcttgacatggccttaaatgacatgcaactattctttttggtgacagctcccagaggtgacagtgcagtactcgggaggaattaaaagactttccgtaattttctagaatcctaccactttcaggtgagaatgactgtgcccttctcatctgaatctgacagtgatataagtccccatataaggtgatgatcctgcttctctttgcttgagaggcagcgtcaatgccactctgaaaaaaagtagattctaatttgagcatcatgtgtatcattcaccgtctaacttatgatcttttaaactttccctaggaatggcttcagagatggagaacagttatgtgtccagagtggaatcaggccattatgatggattaccatcatttctccctatctctagaaagtctgctccaaaggtcttttctgcagagaagaatgcacagcgtttcaggatgtcaaaaccttaaatacccggatacttaaagatgaatcgggccctagcaaagaacaggaaaattagtttttccttttttttcaaagtgagaagaaataatgatagtacatgctggaaatataattttgatatcacaagtttcttaggaaaaggaaataataacctataacaacattgctttagatcacaagatagagaagtaggcctgttttgtatatgctatttttggatacctgccttcttaaatttgagttaatcactttactgtgcaagaagaaatcaaaaaaagcaacgatgaaagaagaggctccttctaagttttcaagagataaagaaagtaattttataagagaggaaataaaatgtaatgctttttccagcataaggtgaatgagatcatctgggttaggaagtttttctatgctgggaagatatgataaagtaattgaacataagtgcctagaattttataggaaacttccaaagtcacttgatttagaaggacagatgaggctcaatatggcttcttccctcagaagtggcataggttacagcagtagaaacttaatccagcctcagaaagagttcccaaagcactcaaaagttgtatgcaaaagacttagaaaaccgggctggaaatattttatacagtaaccctgaatgctttaggatggttactttttaatgtattccatgcttgtctaacacctgcccattccagggggtacatacgcaggggcctctccaggcgagcatctcagttatacttccatcaggtcctggcaggaacactggatagggaggctagattcactgcacatcgcctctaccatagctgctcagaccttcatgtgcacacaaaacacccagagatcttgttggaacacaaattgccagggtacaacccaggggaatttgcatttctcacaagatctgcccctgggccccctgcaatgcagatgcggtgggtccccagaccccactttgggcagcaccgatctatacaaccacaggaggaagccctcccgattaacattcaagccaggcaggtgaaggctggccacatctacctgcctgtcccacagggacctccacctttcctttctattcccattctacctttgttcagtaggccttcatcccctcttatctagctactgcagtagcttcctcactggttttttttttttttttttttttttgcctccttttctattctaactctacccattctaatgtatcttgcatacagatagatagatattcattacttttctgcaaatacatcttggattacactttgtctgcctttaatagcattctgtgtcttccacaagatgacagtgaattacatgtgagccttttctacctaaattaccttatattttccagccttcacgtttttgttcaggctgttcccaatgtcagaaatttcttccccattcccgtcctttcctctgcttactgaaactgcatagtttttactacatagctccaatgccccctcctttgtgcagtatccattgattgccctgtgtgaaaatattggattcctcctctacattccaataacaaattgcctgacaggcatgcatgccatttgtgacgagtgccactgatccccttgtaacaggtatttgtagcttccccaccatatctaagcttcttgggtgcagagatcctgatgattctatcaagatctatcacatcttacccacagaaaatgactaatggtaatggtgctgggagaactggctaaccgtacgcagaagattgaaactggaccccttccttacaccacacgcaaaaatcaactccagatggattaaagatttaaatgtaaaacccaaaactgtaaaagccctggaagacaacctaggcaataccatcctggacctaggaacaggcaaatatttcatgacaaagactctaaaagcaatcacaacaaaagcaaaaattgacaagtaggatctaattaaactgaagagcttcagcacagcaaaagaaactatcaacagagtaaagagacaacctacagaatgtgagaaaatatttgaaaactatgcaactgacaaaggtctaatatttagtatctataggaatgtaaacaaatttacaagggaaaaacaaacaaccccattaaaaattgggcaaaggatatgaacagatgcttttcaaaagaagacaaacatgtagccaacaaatatatgaaaaaagctcaatatcaccaatcactagagaaatgcaaatcaagacgacaatgatataccatctcataccagtcagaatagctattattaaaaagtctaaaaaaaataacaggtgccggtaaggttgcagagaaaactgaacattcatacactgttggtgggagtgtaaattagttcaatcattgtggaaagcaatatggtatggtgattcctcaaaaagctaaaaagcagaactaccattcaacccagcaatcccattactgggtatgtatccagaggaatataaatcattctaccataaagacacatgcaagcaaatgttcactgaagcactattaagaatagaaaagatgtggaatccacctaaatgcccatcaatgacagattgaataaagaaactgccgtatatatacaccatggaataccatgcggccataaaaaagaatgagatcacgtcttttgtagggacatcgatggagttgaaggccattatctttagcaaactaatgcaagaacagaaaaccacatgccacatgttatcacttataagtgggagctaaatgatgagaacttataaacacaaagaaggaaacaacagacactgggttctacttgagtggggagggtgggaggagggaaaggagcagaaaagacaaccattgggtactgagcttaatacctgggtgataaaataatctgtacaacaaaccccagtgatatgtgtttacctatggaagaaacctgcatgtgtacccctgaacctaaaagttttttttttttttttaaaagaaagaaaatgactttgttagatggactcctgaaggaatgaatgaacaaatggatgaacggtcaaaataatcaagtaaataaagtaatgttttaggctctgtggtgatcgtgagtgctgtctgtcacatgtttccgctcatctaccttctgagcacctgggaaacttgttctgcctggtcccttgtggttggatggggccatatgactggctttagccaatgagctgtgagtagaagtgccatgtgtatcttccaaccaatgagctgtcagcagaagtgccatatgtgtcttctgacccaggaaatgtgagcagaagtaccatgtggtaccatgtgtgtcttccagccaatgagctgtgagcagaagtactacatgagcttccagcaaataagctgtgagcataagcaccatgtgtagccttcagtgaatgagttgtgagcagaagtgccatgtgtggcttccaggctggaagccttgttatgatggcaccatccaggccactcttattgacactgtgacatgcaactttgaaatggtgcttgttttgtcagtctgggatcctgagcccacaataagcagatccccctgcccccaaccccacagtgggcatattgtgtgagtgataaacaactctttgtttaagcagctaagaagcaggttgctgcgtactgagcagaaccctctatcctcactggcacaggacttttctggatctgtttcccaccactcatttccacctcacgtacagctcttccagccacgaccaggtccttctctcaacaacttctgtccttgaaggtgaccccttattacccattttattctagtaacataagactcccctgtgtctggggctttgcttcctgttttctatttacagctaatgatatctgagtctcccacctcacagctgagtgatctggtctgtgctttgggaccacccctgggattctgttacagtgaatgttctcatgtatttagactgactttggaacatgaaagctcaggagaagaggtctccctgcaatactcctgttacattttgcaatttagaattaaagcagatgtacaatcataaagaaaaaggaaaaaaataataaagtgatttttttaaaaataaaatttcagtctttgtgggaggggatggattgagcatttccttgattggattgttttgctttggtaaaaaagcacagactgtcttcttaaatgcatttctttttctttttcaatagtgaaaggtagtgaaaaaaggaaagaaatgagcacttttaacaagaatattttcacacatattacctgtacaggagacataatcagtgcaaaatggaaatgtgaagcttctcattcaaaaactaagatttgcaagatgatgacagcagtaaataaataaaagcatcggttttttctgagtgtggggccctgtgtgactgcaccgtttgctcccccataaagccagccctgcctgtgacatggcagccttctaaaatcctagattttttgctcctccacacattgtttcagcactgtattccatgacttcagagaatgcccaggtgtgattgctgaattcggtgagcatttctggaggagaaaaggataatgcaaagaaagaggaatggaacacccttgccagcagccaccattgcttgtcatcacattaatttcccccagtgtcatggagacggtctaccggggcagtgatccacacaggcatcagagggagggacctctgacggtgacggggtcatttcccatctgtgatgttcatttcagtcctgtcaaccccagaaagcacagctaaagacaagtggaaaataaatgcaccttgatgcccaaatgggttgttccttccccatttagacaacacaaggaggagaccatttttaaactggtctactgccatgtggaaatggaccattctgtcacggtgaactaatatcttatgacttttatcatactgattggagccaaactgttattaaaattcacaattgtgaccgggaagagtggttcacgcctgtaatcccaacactttgggaggccaaggcgggtggatcacttgaggtcaggagttcgagaccagactggccaacatggagaaaccccatctctactaaaaatacaaaaattagctgggcatggtggtggacacctataatcccaactacttgggaggctgaggcaggagaatcgcttgaacccaggagaaggaggtttcagtgagcccagattgtgccactgcactccagcctgggtgacagaatgagactccgtctccggaaaaaaaaaaaaaaaaaaagtcacaattgtgcagcagtagactactctccatttaatcaatcattttcttaagtccctgtgcctggtttgcattttgttttctgtgatgcagatctaagaggtctgagatgaatcctgaagggatggggcgcacgaggaaagctgctgaaggtgttctggaccaaagctaagtagcaccttctgcttcatggtccctcacagcagtggtaggtaggtagttaggagctctgctcaggttggggcggcgagggtgggaaacgtgagccagaaaagccccagaagtaatctgatgtgcagtttgtaacagacctcattttcctccagaagccagggggtgggatgggtgaaagaggagttttaaaaagcaagaaagctcagtgctgttatgatttgcatgcagaagtacttgaaaatctgtactggcaattagctaatgagacagtgctcatttccgccgactgccaagggcttgacttcctagagagctgagcgaggcactgggaatctacaggaagaaaatcgagggagggagggagggatgctcctgcttcccccagtcaccttgaaccccttccttacatgtggcaaccatgttgttccaatgccagcccaagtgtcacagaatagctgtgagagaaaataaacaaagaatcactccagtaactttcagcacaatttattggcacttgtgtcttacggctgctgccgcctgttggggtaatgacacatgatgggtgattaaggtgcaagtccttaaatcaaagctgtgcatttggtctggagaggcagccagcagccctgagtttgctcatccctctgagtgggaggacctctttaggacaaaaaggggcctgttatcctaacaagggcaagtcctcgtgtctgggaactgtttcatgttttcaggatttaccctagctcctctctgacacatgagaaaaaaggaaagctgagagggtagcccagtccatcatagcttgctgggtgatttcgcatgaggttcccggggctgggatggcttctgaagatgcctccacctgcacctctccctgaagggaggcctatcaagcagcaagtcaggggaattttgcaagtgttttgatgacatgaatctctgcttttcaccctttcagggttggtgctggcagggaggctcgcttaggtgggtggagctcatagtctctctttttcctttatgccaggaattaacaaatgaggaagagattgtgtgtgagcctccctgagccatggacattacacctctggtctgccatgggcttttgtgcttttcattattctgaaactggacaaatcaatgacgctttcatacttatctagccaggaggaggaacggggatggtagattgctgataagatccaggttcctgttccttaaaaactaggagctccacagcaatggatcagaaggggccaagcttacctaagctggcaggatagggaagtcccttctgttttagccctttaaggacagtcacttttaaactacccatcagatttttgttctctgtatctgctttcctcaggccttttctctctataaaccccacctcctctgctcagctcatgggaacactcattctatggcatcaaatgaggtgttgcctgaatctagactctcaaataaaagccaaaggagattttaaaaaacatcctcaagaagcctgttcagagagcctgagtgaacatgggcaagaatcccatactcacttcctatacgtccagaaagaagcagaaaagaggctctggcatggtggctcacacctgtaatcccagcactttgggaagccaaggcaggtgaatcaaatgaggtcaaaagttcaagaccagcctggccaacatgatgaaacccagtccgtactaaaaaaaaaaaaaaaaaaaaaaaaaaaaaaaaaaaaattagctaggtgtggtggtgcatgcctgtagtctcagctactcaagaggctgaggcaggagaactgttggaacctgggaggtggaggctgcactgagctgagatctcgccactgcactccagcctgggcaacagagagagactctatatcaaagaaaaaaaaaaagaggccccaggagagcaggatcttggggtgggtagatgtgcactactcatgactaacacggtgaagaagtatccaacagcaatgaaggtgaagtccatactactgtaaagaacagtgctagaaatcaggcagaagcccacagtggatagcctggagagggcccaagtttaaatctcagctttttaatttcctgctgtgtgaggagtccccaggatgcaggactttcaatgtggagactgagagagtcccagggaaactgagacagctggtcacctatatgtggccttgggtcaatctttaaccttgatgaatgtattagtccattttcacactgctgataaagacatacctgaggctgggaagaaaaagaggttgaattggatttatagctccatatggctggggaggtctcagcatcatggggcgcagggaaaggcacttcttacatggtggcagcaagagaaaaatgaagaggaagcaaaagcgcaaatccctgataaacccatcagatattgtgagatgtattcactatcatgagaatagcatgtgaaacgctgacccccatgatttaattacctccagctaagaccctcccacaacacatgggaattctgggagatacaattcaagttgagatttggtgggggggcacagccaaaccatatcattctacccttggcccctccaaaatctcatgtcctcacatttcaaaaacaatcatgccttcccaacagtcccccaaagtcttaactcatttcagtattaacccaaagttcacagtccaaagtctcatctgagacaaggcaagtcccttctgcctatgagcctgtgcaatcaaagcctagctacttcctagatacaatgggggtacaggcattggggaaatatagccattccaaatgggagaaattagccaaaacaaaggggctacaggccccatgaaagcccacaatccagcagggcagtcaaatcttaaagttccaaaatgatctcctttgactccatgtcttgcatccaggtcatgctgatgcaacagatgcattcccatggtcttgggcagttccacccctgaggctttccagggtacaaccttcattccagctgctttcatgggctggtgttgaatgtctgtgacttttgtaggcacatgatgcaaactgtcagtggatctaccattctggggtctggaggacagtagccctcttctcacagttccactaggtggtgccccagtagggactctgtgtggggcctctgaccccacatttccctttgacactgccctagcagagattctccatgaggaccatgcccctgcagcgaacttttgcctgggcatccaggcatttccatacatctcctgaaacctaggaggacattcccaaacctcaattcttgacttctgtgcacccacaggctcaacaccacatggaagctgccaaggcttggggcttgcaccctctgaagccatggcctgagctgtcccttcgccccttttagtcatggctggagtggctgggatgcagggcaccaactccctaggctgcacacagcatgggcaccctggtgttggcccatgaaaccattttttcctcctatgcctccaggtctgtgataagaacggctgctatgaagacctctgacatgccctggagacattttccccattatcctgggaattaacatttggctccttgttacttatgcaaatttctcctcagaagatggcattttcttttctatcacattgtcaggctgcaaattttccaaacttttatgctctgcttcccttataaaatgaaatgcctttaacagcacccaagtcatcttttgaatgctttgctgcttagaaatttcttccaccagataccctaaaccatctttctcaagttcaaagttccacaaatctctaggacaggggcaaaatgctgccagtctctttgctaaaatattataagtgtcacctttgctccagttcccaacaagttcctcatttccatctgagaccacctcagcctgacgttattgtccatatcactatcagcattttgggcaaagccattcaagtctctaggaagttccaaactttcccacatttttctgtattcttctgagccctccaaactgttccaacctctgccggttacccagttccaaagttgcttccatattttcaggtatcttttcagcagtgccccactctacaggtaccaatttactgtattagtctgtttccacactgctgatgaagacatacctgagactgggaagaaaaagaggttggattggacttacagttccacatggctgaggaggcctcagaatcacggcaggaggcgaaagccacttcttacatggtggcggcaagagaaaaatgaagatgaagtaaaagcagaaacccctgataaacccatcagatctcatgagacttattcaccatcacacgaatagcacaggaaagactgacccccatgattcaattatctcccactgggtccctcccacagcacatggaaattctaggagatacaattctagtagagatttggatgggggcacagccaaatcataccaatgaacatcagttttgtcatctgaagcagggcagatagttatgcaaattgcagtattgttggatattagctgatatggtttggctctgtgttcccacccaaatctcatcttgaattgtactcccataattcccatgtgttgtgggagggaccaggtaagagataatctgaatcataggggtagtttccccgatactgttctcatggtagtggataagtctcatgagatctgatggttttatcagaggtttctgcttttgcatccttctcattttctcttgccgctgccatgtaagaagtgccttttgcctcccaccatgattctgaggcctccacagccacgtggaactataagtccaactaaactttttttcttcccagtctcgggtatgtctttattagcagcatgaaaacaaaacgatacattagcgtagaaatatattcaaatcatgggaattgtgaagggtgaacaaacacgagtatgaaagcaacatttcagcaggtttgagaaagttgttcatgaaggcagctgtctctctggagtgtgtgatgtggcaggtctcagggtcagaagtgagctctctttgcaacctggtatgctgggagttaagctttaggaaacacagagttgaggtaatcatggcttcatggggaaaatgcaggggttccttgcagccagaagagaagagaacaacctccaagctccaaagaaggatgaaggagttaggtgtgtagccccagcccctaataaggaagaggcctcaaggtattttgtctgagatcaaggcctcctggcactattccaagtggaaggaaaccctaagctgacacacatctgagacctgggtggagccatttcaaaggaagctgaggtccttctcttgacttttaaccttgagaacatggtcactttgtactgtttttgcaggttctactcacattgaccttgactccatgaccttggaatttaaacatgagacaatgtcgtatccttgcctgggtttggcaattgcagggttcaggccagtagaatgacctatgacggtttggggattcacagcctctgtcgcaagcttaattcatgcagcatctggggaccccaacactcttcatgtggtctgcgacatctctgaaaaacttctacatggtaaggaattttggtgttttttaaaaaagtcaagggcctcaattagaaatatgaataaagggagatgaaggctacttcctttaaggttgtatcaagacaggaagacataaagtaagagtgtatatatgacactatgtggtaagctgcagataaaaatttcaatttagcttgatgcatcttctgtggttctttcataattttttaaaaaattccacacttaaacagttgtgatagatggcctgctaatacagtgcaaaatgtggccattttacattttctcacaaagaattaacccagaatgtctgaatccccagatggcttcactgttgcctcctttcatccccgtcactaatctgtgaaaaggcagccctcacattaagacactttcctgaagtggcagcgacagctcagtgagggctgctgtgctgcactgggtcggggctgacgttcccaacctcactgctaatgagaagacttgaaagattactgacatgttcatgttcatggaggtggccggaagtaattaagcactcttcaataaagggctaccttggcaagttcaagatttgaatgggaaaagggtgatggctgggctgggtgcacatgttacctgcatctccaagaccctgtccttcttggcgtctttccctgcttatcagaccagttctgggcactgataacaccacagagcatttgctcaatctctatcacctgatatcctgaaaagggagtggaggcctttttgcagacttctgggctcccacagcccttgtgctgcagcatgctgcctgccttctcttctgtcatcaatgaaatatggtggagggagctatgctgctgatgcagcttggaggctgtaagggaccagagtcaaatgggccatcgagggctggctacacagttactgggctggccatgtgatagagagtgcagaccactaaaaggcacatagcagaagaatactgagtaacacagaaaaaaatcaacacatatagatcagaataaaggctaagttattaaacagtacattcagatgtttctagttacagaaaaatgcttcagcacatattagcagagagaaaaaaaaataggccacaaggagatttatcactatattaatttttttttgtgagggagggtttttctcaccattcccgatgtttccttctacgtagatcagacctgttgaggtaacacttctcctatttcctagtcttcccttgttttaatttgggatagaaggaatgacttacacttgataatgagtttggaagtgggaactaggcatatacagctctaccctttcctgtactttttgttgggagctgacagttcctaagaaacaccctgtagtgggcagattccaagatagcccccagtgatcctgtcccctgatattcatgcccttgtggaatctcctattcttgagtgtaggtaggtcctgtgactttcttctaatcacttaaatatggcaaagatagtgggacatcatttccttgataagctcacatgatattataacttccatctttcaactctctctgttgccttctccacttgcatgttttcttttctttcttttttttaaaacaaaacaaaacaaacaaacgacacttgcaagcaagcagccatgttgcagacatcctcatggcaaggtaccaagggtgacctttacttggccaacagccaaagagtaagtgaggccacaagttgactcctgacaacaattacatgaacttggaagcagatccccacttgagccttcagatgagacctaagccatggctactactttgattgcagccttgaggaagacattgagaaagctgtttgtttcagatggttgaagccaggacctcagtaagctatgtctggactcctggacccacaaaaactgtaagaacataagtgtatgccattttaagctgcaaaatctgtgataattagttacaaagacatagataataaaatcagacctttatgccataaagtatgcatgggtggccctaatctttggtagggtacagaggtggtattggggtcctgtgatgcctaggactgtctgggtaagcctactggattcttagcttaagttatgaggagtatctgcccatagatataaacagcattgtctcacatgaattttatctttgacaaatgagattttgttgttttcctcctttgtttccctcataaatttcagatcttgagtaggaaaaagagaaatatttctatcaccatcttttgagtgttgggataaggagagatttttctacctttcaatctattattttatttttaaaatatatgggaacctgtgtaattgttataatcagaaaaaaaatactaagaagggccagccgggtggccaggtacatgcaagtgagttttgatagggactttttactattgccctagactttgtttctatgattcaagattgaggatcaaagtatcacatccttaaacttttttcaagactatgggaaccagattcccattaaaggcttaagttctgctactctcaatcattactccagtccccacaacttcccaacgtataaaacaaaattgggggaagtggggagaaagagaaaattgtcctgggttactagagagtgctaaggctcgagttgtctgtccccctagacccaagtaaggggcggggggctgagaacgtatcactcacagaggttgggagtgcctgtaaagtgggtaaatggaatttatattcttctgtttgctatttaattgggaagtgacatgtttatctgccttacacatacctgagcaggaagacataaaccaggagggagaagacaggtgaagtgtgagcacaggacgatgatgcctaagtttccatggacactacagaaactatctgggcttaggatggttggtccacagtgagggaattctgtagcacaagtctctgcaaggcattggggagcatcgtgggagggaggatgttatttacctctttatcattctcctaactctgttagggactgtatagcagggagcctggaaattccctgccaaataaattgcatgtatttgattacatgatacaatgcagaatatatctggtctttgttcctggttccgggacagagcttcaaaacctcttggagttttcagagtgatagaaatgtcttcagttactcacaacagaccctttctacttctgcagtacctgagtttatgctaatgaggtgacttatggtgggccctcagatgattatcaaggaggggctggccttctggaaagaccaaccatgtgatgagaggagggggacattcagcctcaccccctgacctctggggaaggaagaggggctagaaatagatctcagtcatgtggccaatgatttaatcaatcacgcctccgtaataaaacttagataaaaactctgagcaatgcaactcagacagcttcctggttggtgaatatatgggtacgcccggagggcggcacaacccagatccacaaggctggaagctcctgtgctcaggacccttccggatcttgccacatgtacctgtgcatctggctgttcactcatgtcctttttggtaaaatggtaattgttaagtatggcattttcctgaatgctgtaagaggttctagcagattatcaaacccaaggagggtgtgctatcttgaatttgcagctatccaggcagaagtgtgggaagcctgggaccccactcactgctggtgtctgacataagagcagtcttgttagggatcttgccctttaactcatgggatctgatacgaactccaggtaattagtgcctgaatcaaactaaattgtaggatacccagttggtgtcagacaatattgaaggctgttttccatacagagtgagggctttgatggtcagtaaatattagataaatagtcacagctaagataaatgacagagcctttgttttgcatgatctcctcatatcatatcaccccattacaatagaggcaagttaccctgaatgaaaagaccaaacactccaggcagggggagggtggaatatcacagtttaagttggactggctatgatgatataaggaaataagtaaaagctcagaacccggtggaaggtggtgatgggagcaaatttaaactgattcattatgctcccccattcctctaagcaagaaaggattttctgacgcatacaaaatgatacagttggcaatacgaatgcatctgatgcttatagtcatgagcttttccaaccattgaaaacagaggtctcacctccagaaaactgaggtacattatgacttaacacacagaatcaaggtgactggttcacgggggtgggtataaagcccaggcccccagccccagccaccttggaagggccacccagcttcagagctctttgcaggatcagctgggccctgcttgcatctgcatcccagcttctttctgtgcctctccaacttcctgtactccccctatggcgttgatcccaagcgctttccagcaggtttccagcacacagatccctgccagaagccagcctaagacaatcctcctttatccagctttccactcaaaaatcagcgtcctcagagtggctttcccttatctctcacgtgccatctagtaagtgccttcattatatttggtgcatgttttaactgtgagattattcatctgctgatatgattaatgtcaaattataagctccgtgtgggtaaaggccccctggtctaatcacaattgcatctctaaggcccagcactggcagttgtatagattagacttccaatatataattatggaataaacaggtaaataaaggatgttaaatcccattgaggagacgactccattttttaagtctcctactcagttttcctctatatccattcatccctttaaccattgagtacctgctgtgtatgttactgtgtgctgggtgttctgtgccagagagtggtgactcagacagctcccgctccgtttttgtggtgtgattcatgaagccgggttccgctctgcaaccccatgttatggtttgagataatgttacaaatgatctactacatgtatgtggctcttttccccagtgagtctataaaagacttaaaggcgaggacatttacagtccttgctcatagcaatacagtaggcagaataatggtgcttcaaagacctccccggcctaatctagggaacataaatatgttactgtacacagtgaaaggtattctgctgatggaatgaaggttgctaattaactgatcttaaaatagggagaagatcctaaattctctgggtgggtccagagacatcgcatgggactttaaatgcagaataagaaagcagaggagtcagtccatgccttgtggcagaaacagaagcaaaagaaacagaacagaaggagagtcagagatctgaagtgtcagaaggactcaccccacacttggctaattctgagatgtaagtgattatatgcaaggaatagaatgaggcttataggagctcaggacaacccctagctgacagctggcagggaagcagcgatgtctgtctcacagccacctggagcagaattctgcccacagtcagaaagagccaggaagaaaattctctcccaggtcctccagtaagaggagcacagtgctgcggacgctctgactttggctttgtgatatgtgaagcagagaaaccagccaagccactggatgcccaacctgcaaaactctggataataaaagggtattttccttaagtcactaagtttgtggtagtttgtaatggcaacttgagaaaactaatacagaaggtatccaatgtatgttttggacttgagtctttaaaactctgtattcccaaattaaaatgcagcataccctgaagcatttacagagtgaatttgcagtttcaactttttgtaaacagcatggaagttcacggcatgttaaaatatgcacacgttaatatgtgtcattttgctgagggaggtatttaggtatttaggctgtgggtgctacaaggcatgtgtgtgggaatataatccttcctgaacttttaggccactaatatcaaaatctgcattagtcagggcttcccagagaaacagaaccaataggagagagagagacagacagagagagagagagagagacagagagagagagagacacacacagacagacacacacacacaaagagacagagagatttatgataaggaaccactccatgaaattgtgtgggctagtaagtctaaaatttgccgggccagccagcaggctgtacccaggaaagaactgatgtgcagcttgggtccgaaggaggcagcatctcctctttcttccagggacttcagtctgtttttctaaggacctttaattgatgaagcccacccgcattatgaaggataatctactttactcaaaaatctatggatttaaatgttaatcacatctaagaaataccttcacagcgacatctaggctggcttttgaccaagcatctgagtaccatgcctagcaaaagtgacacatacaattaaccatcacaaatccacaccttgtcaactcggcatccatgcacgtctgcttacaccatacttactcttcaaataaagacaataacaaggttatacttccacttcacataatatcactaccctgagcacaactgaaagcacacaaaccctgtccctaaaagaaaagcaaagtcctttggtgatgttcatgcctctccttaatgtcccgtaactttactactatgatgtgaagttgacaatacttaaatactatgatagcaaatcaatgtatcatatgttatatgataatgggataagagaggaaagaaaacaaagatacaattgtttcttggtatctttggggaattggttccaggaacccctcatacaggatacaaaactctgagagagttcaagacttttcatatgcactggcctagtatttgcagctaacctacacacatcctcctgcacactttaggtgccatctagactacatatgaaacctaataaaatacaagtgctatccaaatagttgttgtattgtactgtgttatatttgtatttatgtttattgttgtatttttttgtttttttttccctgaatattttttatttgaggatggttgaatctatgagtgtggaagctgcagattcaaagggctggctgtatttgctgaacacacacacacacacacacacacacacaatggcaaacgcactccctggcactgcctctccacatggctatgctattctctcataatgcatcatccttagccttttacagtgattaccttgggagacaggactgaatgagcagaatggattcatttagcattactacaatcccaatttttacagttgtggaaataattttacagtggcacatgagaaagaggggcttctcagaggtcgcagaaaataaaagacaactcaggacttccaaacgttaatttttttaatgctcatgcacttacccttgtttttttctcctggcttcaatacatggccaaggtagcacagaggtggctccatggtgtgatgacaatgacaacactcatggtattatgtgcctgttaatgcagtttatggctacagaaagcccctttctccttattcttttcacagagcaatgtaccttccccttgctgcattatcaatggggttttaagcaaaagtgctcttttctcctcttgcacatttacaatcaatggctacagactcagaattgtgaagtgctttctgactgttttgtttccattttctagcaatggcccattctgtatcaatctaaatgagccacagaaaacatggcatctgacctgcatctccggggagaaagtattgttcctagcagcattcagcagtaccatatacaaaaaggagaagcgatgaaaacctaaaagcatgtcttccaaaacttcttcctggagatcttcttctatgtctggcatcagctctcctgctctttccctcttgcatttcttcctgctgcaaacactggttgagaacctactacttccaaggcctagaaatgttattctcaaatgacaggaacacatgaaattgtttccaagctgaatgtccaactaagataacagttgcaaaatgatgccaaaccataaagtgaaatatgagctactcctgaaatacaataaaatggagctatgtgtatttatctgtgtaaaaagtaaagtagaggttcctcttcaaagactttcctccccatctaaataggaataaacagtaacttctcttagaagcgaaatttattcaaagacctgtgctaacattcttaaatgtctgctagccgcaatgaagaaatcaaggtactttatgttcttagctcccacaatttagcttaaatatctgccctggcatgcttatactggtccaaacaagcattaggtcatagcctgttcctcttccttatttgaaggtgtttctacctttctcagcattccacaagttacttcctccttcttttgttctcctctctctttacctcttttaaaaagttctaagttgctagccaatcgagacaaacacagaatgtgaggtcccgttccagccaatggaaaccagacacagcagtagagtggacacctcaggttataaacgaccctgtctcctttgtttggtgtactcttggggcaaaactgctggcgggtgtaccccttctgcagaaagtaaaaatggcactgctgaggagattaaatttatgttgaagtgctatttctttatggcactgaggaacaagtatttctaacgtctggaaagacaactgtgatatattgtcaacttaaaaagcaaatgcatactaacatatactctgtgatttcattttcttaaaagagaaaacgcttacacatatgaatatgcctactaggaaaaaggaaaaatgaagagcctggccatccatccagagtgcaatgcaaagttctcacctccctcgaaggatctgatctcctctttaatgaactctttttttttttttaccccagcagtgtcatggaggaaacacaccaagcttcctcttgccatagggccttttctctggttataccatctccctggaatgcatatggcttccctccttctcattaagaataaagactccactctgagcaaatacagaagctaagtaataaggggcaagaagctagacagggacttcccagtatggagcagatcccacagcaccaaccagagatgagaattaggccacacctgtaaagaggcgatgcatctgggcccagaagttaaaagttacctccatttccttagaaagaaggctacaactggaatcagttgaatactggttactgaatagttcttagagagaatgaaagttttgagtcagccattcttttttttttttttttttttttttttttttgagatggagtctcgctctgtcgcccaggctggagtgcagtggcgaagtctcggctcactgtaagctctgcctcccaggttcacgctattctcctgcctcagcctcccgagtagctgggactacaggtgcccgccaccacacctgttataaatgaccctgtctcctttgttcggtgtactcttgtacagttacaagagtactagttttttgtatttttagtagagacgggatttcactgtgttagccaggatggtctcaatctcctgaccttgtgatccgcccgcctcggcctcccaaagtgctgggattacaggcgtgagccaccgcgcccagccgagtcagccattcttaactaacaatgcttatcctgtgtagtccttcaggttttattatacaacatactgatgattaaagtcacagttccagtgttcagaatgagctgaaaatcaggtgctcttttctgctcaagcatctttggaatgagaagatccttacttgcctgtgtatacatggactgtacacctctgtaatgtgtcttacaatcagtagccaaacggatagccacaaaaagtggacatctaacttgaggttctggaatcaattggcttaagggtgtggaaattgaaataaataggtgggaaaacagtatattcaaaagtctaccacctccagccctgtctctgccttcctgcctcagccacagctgaactgcaaagagcagatggtgggtcactgccctgtagcatggacacttgccatgacctgccattgctttacaaatgtgcatcagtgactctgctccgtagctgttgtctttggatatgtcctaacatgaggagtgaggatggtccctgcagagggtcacacctgggagtcctcaagagaaaagtgagcatcacaaccaggcacttgcattctacaaagaataaatcatcagagaaacatctccaagccttgcctgtccatcagcttatttccatgtacccattcacaaggcccattgcaggtcaggagcttgtttcagctgagtttgcaataagactggtctagtggcccttgatgaaagcacttatgtgtagcttctcttcttaattaagtctaaacaaaactatgtattgtcttctgcatccttttcaagatgaatgatattaaaaatgattacatgataataatgaaactagagattggaaaaaagcccccgacatccaggagctggctgggaactcccacctgggccttggtgttctgttattgaagataaacaatttcacaaaacactaacatcagacaaaacagctctgtgaccgagatggatcaagacaaaagaagacccctccgttatcatgtttgaacatagacaatagcatgagcattgttcaaagaaaccacaacaatgaccaaacatctgttcttttgtctaacgtgactgaccactgcttctttacccataacagcattagcctggcttcatttctctcatcttatgaacaagatttattaaatatctgctatggtttgaatgtttgtcccctctgaaactcacagtgaaacttaaccacaattatataactgtgctaagggggtgagaaatcttgcccacatatttggtcaaacatgattctatatgtatctgtgagggtgtttctgggcaagattaaagccgaattggtaggctgagtcaaacagattgccttttctagtgtgcatgggcctcatcccatccatttaagacctgaaaagaacaaaaagattgagtatgaagaaactctgcctgcctgatggctgagctgggaccttggtcttttcttgtctttggacttcgagtgaaacattggctctccttgggtctagagcttgatggctttcagattggaattacacattggctttcctgggacttcttagcatccataatcatgtgggccaattccttataataaacttattctctctctctctctacacacacacacacacacacacacacacacacacattcttatataagtatatacatatataccaatataaagagatataaatatgtatgctaataaatagcactatctctctatatgtcttattggctttgttactctggagaaccctgacaaatagaaatttaatgttatggatttaatggtagtacctctccaaaattcatatgttgaagccctaaccaatgtaatggtatctggagacagggaggtaattacttttgagaggtaattagagtgagatgaagtcatgagaaggtctagtctgattagatcaatatccttttaagaaaaggcacctgagagttaacttgagtgttctctctctctctctttccctccctccctctctctctccctctcgctttctttctttctttctgtccatgtgtacataaagaagtaatgtgagtgcacagtgagatggcagccacccacaagccaagaaaagagacctcagaataaaacttaccttgctagaatcttgatcctggacttttcagcctcgataactgtgagaaataagtttctgttgtttaagcccacctcccaaaagagggtgggaaatctaaccacggtatttgagaggcaggatatttaggagataattagatttagatgaggtcagcttcctcaccatgtcatgctttatgcagcaaaaagcctctgcagagagtcctcaccagcattaaggcccttacaggtgcagcctcttcaccttgaacttgccccgcctccagaactgtaagaaataagcctattttctttataaagtacccagtctcaagtaataattatagcaacagaaaacaaatcaagacaatacccaatcatagaattactcccactttctggcagcgtcactccagagttaggtcctacttacttgaaccttcccccaaatcacctaacacaagcccaagtttataatacgtccttcccaacaccctcttatgaaggcatctcattgtttccatgttgtatgctttagctcatgacaagaataaactcaacttggtaccctacaagtatgtgactgatgggctttggctggagggcagtgatagaaatgaggtacaaggacagcagtttgggaatcccagctcagaggcttggctgactgtgcctaataccgtgcttggcacatggtaagaactcagcaaatgtttcttgaatcaatgaaaagaatcaggcagctcctgttgaaactaatgtgcatgcaccttggagctttcttgccattggccatctcaccatgaggctgttaattttgcaaaaatattcaaacataattaagagtccaatagtattaaattaataaggatgtgtgcttaggctatacaaataaaagagaaagccaagatacctttttaaaatgccatacaaaattcaaaattctttggtaaaaattaataaaatatgtctaagtccaaaatggagacaactgtgcctcttcgttaaggaatctaccagaaaactaaagacaataaagagaagtttcatttctggatataatgactcaatatggtaaaaaggtgggtccctcacattaaattattctataaataattacttaatggttatttttgaaatagacaaaatcatgtttaggtttacctggatgaataaacgtgtgagcagagcaaagaaaatttcaatcatatcaagtatcttctcagaccacagtggaataaaaccagaaatcaattccaaaaggaaccctcaaaactatacaaatacatgaaaattaagcaatctacctctgaatgattttggggttaaccatcaaatcaagatggaaatttaaattttttttcaaaatgaatgataactgtgacacaagttatcaaaatctctgggatacagcaaaagcattgctaagaggaaagtttacagcactaaatgcctacattaaaagtctgaaagatcagaagttgacaacctaacatcacatttcaaggaatgaaacaagaacaaaccaaacccaaagctagcagaagaaaagaaataacaaagatcagagcagaactaaatcaaattgaaacaaaaaaattataaaagatcaatgaaacaacaaggaggttatttgaaaagataaataaaattgatagaccactagctagattaaccaagaaaagaaagaagattcagataagttcaattggaaatgaaaatggagacatcacaactgacaccacagaaatgcaaaagatcatttgagactactatgaacaccactctggacacaaactagaaaatctagaggaaataaataagttcctggaaacatacaaccccatagcttaaatcaggaataaatagaaatcctgatgagactaataacaagcagtgatattgaatcagcaataaaaaaaaaatgccaacaaaacaaagcccagggccagttggattcacacctaaattctaccagacattcaaaaaagaattggtaccaatccttctgaaattattccaaaagacagagaaggagggaatcctgcctaacttattctatgaagccagtatcctcataccaaagccaggagaggacataacaaaataggaaaactacagaccaatattcctgatgaatacagatgcaaaaattctcaacacaatactagcaaaccaaatccaatagcaaatcgaatccaatagcacatcaaaaaaataattcaccatgataattctaaagatgcagggatggctccacatacgcaagtcaaaaaatgtgattcatcacataaacataattaaaaacaaaaaccatatgatcatctcaatagaggcagaaaaaacatttgataaaatctaatatccctttatgataaaaactctcaacacactaggcacagaaggaacatacctcaaaataagaaaagccatatataacaaacccagagcccacatcatactgaattgaatggggaaaagctgaaagcattcaactgaagcaagacaacgatgcccactttccccacttccattcatcataatactggcagtcctagccagagaaatcaggaaagagaaagaaatcaagggcctccaaataggaaaaaaggaagtaaaactacctctgttagaaaaccctaaagactcctccaaaagactcatacatctgataaatgaattcagtaaagtcttaggttacaatatcaatatacacaaatcagtagcactgctatataccaacaatgaccaagctgagaatcaaacacgatctcaggctgggcatggtggctcacgcctgactttgggaggccaaggcaggcagatcaactgaggtcaggagtttgagaccagcttggccaacatggtgaaaccccatttatactgaaaaaaaatataaaaattagccaggtgtagtgacaggcatctataatcccagctactcgggaagctgaggcaggagaaccgcctgaaccaggtggcagaggttgcagtgagccgaaatcgtaccacttcattcactccagtgtgggggacagagcaaaattccgtctcaaaaaaaaaagaaaaaaaaaagaactcaacccctttaatagctacaaagaaaataaaacactttatttttaaaacacttaataaatatactctaccaaggaggtgaaaagatctctaaaggagaactacaaaacactgctgaaagaaatcatagatgacaaacaaatggaaaaacatcccatgttcatagattgaaagaatcggtattgtggaaatgaccatactgctcagtaatctacagattcaatgcaattcctatcaaaataccaacatcgtttttcacaaaataaaaaaaaaaacataaaattcatagggaaccaaaaaagagctagaatagccaaagaaatccgaagcaaaaagatttattcttagaatcacattacccaacttcaaatgatactacaaggctatagtaattaaaacaccattgtaatgatataaaagtagatgcatagacaaatggaacatgatggagaactcagaaataaagccaaatacttacaactgactgatctttgacaaagcatataaaaacataatggattagacacacaatttaaggagaatacaacttattcaataaacggtgctgggaaaatcaaatagccacatatataagagcgaaactggattcctatctctcaccagatacaaaaattaactcaaggtggattaaagacttaaatataaaacctgaaaccataaaaattctagaagaatccctaggaaaaactcttttggacattggcctgggcaaagaattatgtctaggaccccaaaagcaaacgcaacaaaagcaaaagtaaatacatgggacctaatgaaaaagcttctgcacagcaaaataaataatcatcaaagtaaacagacaacctacagaatggaagtaaatatttgaaaattatgcatccgacaaagtactaatatccgcaatctacaaactcaaagaaatcagcaagaaaaaacagataatcccattaaaaagtgggcaaaggacctgaatggatatttctcaaaagaagatatacaaatggccaaaaacgtgtgaaaaaactgctcaacatcactaactattagggaaatgccaattaaaaccacaatgagatacgaccttcccctagccagaatggccattattaaaaagttaacaaacaatagatgttggcatggatgtattgaaaaaggaacacttacacactgctggtgggaatgtaaattagcacaatctctacagaaaacagtatggaggtttctcaaataactaaaagtagatctaccatttaatccagcaatcgcactactgggtatctatccaaaggaaaagaagtcactatatcaaaagacacctgcatgtctatgtttatcacagcacaattcacaattgcaaagatatggaatcaacctaagtgtccattaactgatgaatggacaaagatgttttatatatatatatatatatatatatatatatatataatcttgaaattttatatatataaagatgttatatatagattaatcttgtatatcttgtgtgtatatatatatgttagatatatatcatcttgaaattttcacatgcatatatatatatatatatatatacacacacacacacccccacacacatcgtgaagtactactaagccataaaaataatgaaataatgtcttttgcagcaacttagatggaactagaggccattattctaagtgaagtaattcaggaattgaaaaagcaaataatgcatgttctcatttataagtaggagctaagctttgggcacacaaaggcatacagagtgctataacggactcgggagactcagaagtggggagggtgggagggaggtgagggatagaaaactatatattgagtacaatgtacactactcagatgataggtgcattaaaatcctagactttatcactaaacaattcatctatgtcatcaaagtcacttgtacccctaaagctattgaaatagaaaaaattaaaaaatgaaaaaacaagtaacaggtcatctggacacctcctgaaggacctgcctgagctgttttacagttaactttttttttttttataagtagaaggagtagtctaaagtaattatgaacaattagtaaatacataaaccatgaatagtcatttattattatcacaagtattacatagtgtacataatgtgtgctctgctttcgtacactggcagggcagtaggtttgttatgtaagcatcaccacaaacaagtgagtcatgcattaagttacaatgttaggatgttgtccattatcacatatattagatgtatgttaaccattatagctccatcttaagggctactgtcatagatgtggtccatcactgaccaaaatgttgttatgcagcacataactatataacataaaatctggattatgggccgggtgtggtggcttacacctgtaatcccaacattttgggaggctgaggcaggcagatcacttgaggtcaggagtttgagaccagcctggccaacatgctgaaaccccatctctactaaaatataaaacttagacgggcatggtggcaggtgcctgtaagtccagctacttgggaggctgaggcaggagaatcacttgaacccaggaggtggaggttgtagtgagctgagatcgtgccattgcactctagcctgggaaacaagagagaaactccacctcaaaaaaagaaagaaaaatctggattgtgtgggtctatgtatactgtatgtgtatatatacaaacataggcatgcgtatatacacaagtatatacaaatacacacacatatatacattccagcaaacagggtccctgctgctccacagatgtaaccaatttctcccttcagcctttgcccttgctaattcatttgcctggaatgctttctccaagacgtatgcacaccttgctttcttacatcactgtatcctctgccaggcattatgttatatacccatctccatgtctttctcaagggaatttgtgctgcatgacggtgaactaatacttggtcttattcagagcacgcaggatgtagaacaattcttgacactagggagcattcagtgaaccctgctgatgggcaaatgggtgggtctggtcaggggcagccagaagacaggaggagattccaagggaactaagcagtgaccccacagtcaaggaccatatggcactcagacttctcagcagatgccagtgtggaaggtaatggctgattgagggttcagaacatcagtgccactggccacaggggaaggccatggaacagaaggaccttaaatcaactgaaaaacattgaaataggcgcaattaccccaaagttaaaaaaaataataacattttagttgcttggtagaagggtgcctcaaaacagaaggatgaagaggaggaggaggagaacagtggagtggaaacataagatttttactggccccagtaatttttcgaaaggctgtggtggctcatgcctgtaattccagcactttgggaggccaaggcaggcagatcaactgaggtcaggagtttgagaccagcttggccaacatggtgaaaccccatctatactgaaaaaatataaaaataagccaggtgtagtgatgggcatctataataatcccagctactcgggaagctgaggcaggagaacctccctcaccaggtactgagctccctgctgtaagccaccatatgtgcccaggtccgagtgctgccatccaccttcagctatcctcccacggagctgttctgccccagcccaaagcatgcactgcaaatccctatagcttctcaatccagatctaactcctcattcccccagagccatttatttcagcaggattaccgaggggaacactgtggctgaatcgcactccatgaattggagatgctgctctctccttagctaattagtttggatgcctccagctgcaaatgcaaaaaccctgacccacattggcctagacagcaaaggcaataaagtcccaggtgatctcatgtactgccagacatcatggggtcaagaattaaatgggataaacctcttttgcagagtcccgtattaagaatacggaaatcttctccagaaactcctcaaaagaattgtttttacgtttcattgtgcaaattctggttgtctgcccatccttcaatcaaagggagctgctgcgtttgatgggtcccggccagggctcacacccagtggctttgatggattcggactcttctgcttaggcaggggatctggcctgtggtgggcttccctccaacacaagaccgcaaaagagttctgttgtcactgagtgtatggtgtcccggggctgctgtaacaaagttccacaaactggggtgcttaaacaacagcaatttattctcacatctttctgggggccataagtccaaaatgaaagttctggcagggctggagtccctctgaagtttctacaggagaccccttccttgccttgcccagtgtctcttggcctgtggcagcataactccaatctctgtctttgcccagctatgttttccatctgtgtctgcacccagattgtccccttttaataaggacaccagtcatattggattagggatccggcggcctacttcagtagagcctcatcttcactaattatacctgcaatgtgcaagtacgctatttccaaatatggtcatataaggtactggaggttacaaattcaacatacaaatctagggggtggacgggaaataattcaatttttagcacagagaaaggagggaaattgaaactggagcagggatcaaattgcatctgctatatggaccctcctgttttacaaattccttttttaccccagagaatctttagctggtggaacttcaggctgacttaggaagggaaatgcatatgtttgggtggagctcaggatgccctaccaagggcgtggcagctgctgaggggtttccttcactaagcaatgtcccctccagcacacttacgttccctggattcttcccattctctgcttctgcctccagaaatttatgcttaaacaattctggggaccagaagtgcaaaatcaaagtgctggcacagctgcagtccctctgaagcttctgcgggagactccttccttggaaaaactcccagcaaagttgcagacgtatctggcaactggacttgagagtgaagcaggagggatctgagtgttgcatatgtgcaggataaattgttgggggaggactgctgggggtgctggtgactgaatttaggaaagtgcataagctgggtgttcacaaacctgggacacctcatattctatttcaggcactaatttgtcatgtttgggaaggacttaaactataattcagaaatgatgattgatatggtttggatctgtgttcctacccaaatctcatgctcaattttaattccagtgttggaagaggggcttggtgggaggtgattggctcagcagactgagtgatcataaagagcctgggaaacatgtggggttaattcaaggtggccaaagcttcaccatggggggcagcttgggggccgcttgggggcagcttggggctgggctacttcctcctccaagaagtatcacagagcaatgctaccgggactggagatttccatttagctaattaggggttaggataaagatttgtgggtactggtggcagtgggtgagggcagaaagtaaaggaggttgactatggattatccaggcatagatacacatgttttcaacagaaaaggagatgggttattatatgtcaggcccaacatatctgccctggcaatggcagggcttgagagtggcctgaggtcaaatcataacatggagatctgtccagaaatagccaagaccctgcagacggtcaggtcagagctgagtgagttggtgcatgcacatgtgtgcacttgcattctgacagtacagaaatctgatgggcacagcgacccacagaccttcctggattcagcatggaggagggagaccacattacataggctggactagagcccacgggctaactttgggagcttgggggttcactagattccaagagtaactgactctccagggaagcgcctgttcctgtttgataagcggtgctcttttgtcctgcatgcagggatcagaaaggacctatgcagagcagctcacaaaagcagagcggcttgttcactgtgggccacaggttcacgctgaaaccagtgttcccggaaacacgaggcttcagatcagccagtggcagaaagttgggagcggggaggatgtaatttgggcatctgagacaaaccttagggatggctatccatttaagagattcagtgggttttggagctgtgaaaggaaattaaattttgggaccccaaattcgtttagccaaagagaaaagtcaagctgggaactgggtcacgcaaatctgcctccaccttttggttcctaaacaagatggctacaagatgaaaagctacacgcttccctcatattttgcccacaaggaaattcctggtgagctgttaaagcttccccatggcaatgcaacttgatagcctatctttacaggtgcagtcgctctgcccaccagacacaaatgtataactgaacgttcccctctccattttgtctgtggtatgtaaaatgcacattccccacagttttcctctgccccttttgtttatgtgaaagctgtgtgcttctcaatatctcatcctttcccctttaaatttggagccctcaaaatcaccttcggagaaaggaatagacctgtctcctgggagcatcctcaactttggcaaataaatatcctaaaatgattgagacttgtctcattattttcctcgattgacagagctattttttttttttttaacataaagtcattccctgggcctcaaacagttcctggttgggggaaggggcacataagtggcatagcttctgtagcccccgatcggcctggagcatagggcaggatgtcatcaccagaggccaaatttgattgcaagcagagcctactccctctgccttttctgccaagcctcctaatcgttatctcacatgataattattttgggtaaaacataaaccagaattgtgatgacagtgtagactcacagacaggaaccccaacagagctggaaagatttgcatgcagtaaccttccatcccattgattgctttccatgacaattccatacatgcttgctggctttcttctttgcctgtggcttccttatgcttgattcaataacaacaacaaaaagatgtgtgtgtatgtggtgggtgtttattgttaaaatgctttatttttggagtgatgtttcttgaaagcagtaagaaaatttcccatataggagaaaccctctgtgcagggttcgcaggatctcacagtgagcccccagaagcaggtcctatccggagagtttgggtctttaaattatgtttacagccagcaccaggccatcctgggagtccagacttgctgcaggagcagctgtcttaatttcctgacatcatccaattagacagcaaggtctcccctattgaatttagaaatatttgcagcccattttttaaaatgacttacagaaaggggagagtacttaatgtgtttatttagaccagtaaactctcctttatatctattttttttttcagtttgagatcctaaaacactttactgattgttcttaaacaactagggttaggcaaaagacattggccattagagttgctaaagacaccactccagggctgagctttggacgagtattagacaaggatgaaaatacctccccatgggccatggaggtcctctttcttcttcccttttcctagcctctggccttttaattttttttcagaataactttctggaaatgctcctatgcactgtgccatcaatatacattttctctttctttccaaccaaagaatcatttactctatgtatgtattggaatacttatttagagtatcttatgtcttacaatgtgttttcacatgtgttaccctgtttaattttcatgataactctatgaagatggcatagttcttcctattttctaggcctagagagataaactaatacaaacagtcatgaagaggtgcatttaacttatttaaatccacctgtccatgactagcttgtattagtttaagaatctaaaatttggccaactctatcatctctctttgaagtgtgttcactttaaatgttctcctctcccatctcctccatgtactgtagaacattcgaacagagagttactcttgcctggagtctttcagtttcttgtatctggcttctctgtctcctgtccctggaataccctatctagcctcaacagtcctgccttttgaaggcccttgtgtctttaagaccgaactcagatgctgcagcttttcgttccgtagtttcttagtcaactggggctgctgtaacaaagtgccatacattggtggcttatcaacaacggaaatgtattcctcacagttctaaggctggaagtctgagatggggctgccagcaggggcaggttctagcatcctcctccaggttgccaccttcttgtatatcctcgcatggtggaaacagagaacaggagagctctctggggtcccttcgataaggacactaattccatccctgagggctccccctttgtgacccaatcacttttcaaaggcctcagattctagtatcatcacactggcggtaagatttcaacatatggactttgaagggacacagacattcagttcattccacacggtcactgattctacaaacagaagcaaatcataccctcttccatgaaccctggtgttctgggctctgttccaccagttgtgtattctgccagacaggaattggacatatatccactcaattatccccagagagcaaaagctcctagagggcaggggccacctcatctccttagtcctccctgatgctgcacaactgccactgagtaccgagatctggagagaggacatatgggggcatcgtccattcttgaagcctattttccatgaagctttccttaattcccccaagctgacatttccatcctcctctgaatgtcacagacatgatccatgtgactcttcaccctgcattgtaatcagtggcttctatcttcttcctggttatctccccttccaaaacatgaggcttgtcactcatgagggtaaggcccatggttgattgtacttgtatccttcatagggtcttatatatattgggtcctagatatgtgtttatggactaaaaaattgtcttatgcatttaaagtctattaaaataactgcaaaatacacccctttccttggggaaagatggaccgactctggtcaacattgctcctcagattttaggtttcctttataacttttaaaaattaccatttcagctctggatttaaacagtaccacaattcgttatcaaattcttgcacatcatttcctccagagcatacgatttaaaagtcaaaaactaggtattgagtatgtgcaaaatatattccaaaacaaccccatttcataattataatccatttcacaatataaaactttaataaataaacacttggattttttttgttctgttggaaatagtggactaactaaaataaattcttcgtgagttaggatggatacttgtctgtttagctagcctttcaatatcatacacacacaaatacacacacccctgaatgccacttttaaatctcattcttctaataaatcatatagtagagacttttccaaactatccatagcagaattaaagttaaaaaaaagaggaaatccaagggccaggcatagtggcttatgcctgtaatcccagtgctttgggaggccaagaggggaggatcacttgagggaaggagcttgagaccagcctgggtaacaaagtgagaccctcatctttataaaaaattaaaaaaaaaaaaagctgggctcagtggcatacactggtagtcttagctactaagaaagctgaggtgggagaatcccttgagctcaggagttcgagggtgtagtgagctttgatggcaccactgcactctagcctgggcaacagagtgagcctctgcctcaaaaaaaaagtgggaggggagtctgaataaagccttgtaatcaagaagaaatcacagttcattcgatggaaaattccataaatgggcataagccattcactgtaaactagatgcaccatcattttgttaataagcacaactcagtaaaactggttcactttatatcctttccttggttgccagttaccaatgtatgagaataatttcattataacgcacctttttctatatattgggccagcagcgccagcattaagcctagtcttacacatttctgtcttgtagttgttcgctagtcacttgattttaaaatgatccttaaaaggaaatccatggacaagacagcttgcaaataacaaaatgcatgacaaaaggctttgtaaagagcacatctgagaccatgtattgagtttttccacgggaaaatcaacagggtagcaatgtgggtgttaaaggcagagacctactcatctgctaggttgcccagagcccataccaatggctgtgagaaccaaaggaagagaagaatgtggctcatgctccacacacaaggggccctgggcacactgtcaacaattagctggatgtttaccatcctcttcaatcatgtttccagaacaacaaaactttaaacccagctatatcacaccaacgggtcttcttttgtgttgcttttaaacaggtatgtatggagacaattgaaaaaggaagcccccagagacctatgtatttaaactaggtaaaacgaagcatttcttctctcttacttttaaccgtgaggtacatggacttgctgacgtctgcgcccacatcgttgctgaccttgcagaggtagtagccactgtcttcctccacgacatgcttgatcagcaacgacccattgctgagaacttggattcggccatttagggcaattggctggaactggggaaccccagcacctgagacagaaaaagaaagacgagcaatgatgcaaacgagagtaagtatgggaagacaacgagttcaagtacacacagactcataaagagatgcttcacactgatcccataaggcagtcacgggatacaccaggtttttctttctttcctccagtattaaaattcttgtttagagagaaaagcatttatttaaaatgacagtatctcagactctgagataaaaactaacagaacttacagatagtttctctacataaaaagccaaatttgatgagtgttaagtagctgataaattattcaaagaaatcacagtagaacaaccacagaagcagacaactctcatggtgctaaataaattccttgtgttcccagggacttaatatgaatgtaaacaaggagtgctccagggacatggcatttgaagtctttgctcactgcacatgtctgaggctacaaagagaataggaatattgcaggtttctctttaacggtggttatattccggtctagacacacaatacaccattaatatcatttaatgttatttaaataaatacatcagattagtgcagtaagacagcacagaattaaaacacctctctcctcagagtgcttccatgcaaggagggaatggcacagatatgatatgctattataatgaatgtggtatgattcatatgaaggatttatatacaactgggtaaaaaaaaaaaggattttagaaataatgaaacagattatgaaggtcctagaagacttctgggaagatggtgactggatgaacctgccatgctgcctgcttctggcctggaggagttgggtgggctgggagaatgggattcaggccttgaaagactctcccagggcatttttcttctctggcctgagtatctggggacttgaggggaaagctctggggtgaggatcttcctggaggaagctcaacgtttgggccaaagatgtgttctagagagaaggtgctagcttcctggcccaagaacctacacgggagctgaacaagtcagacgtctccacaggcctcaagcaggaaacttcagactttgcatctgaggacaggagaatgggagacacttcctcttgctgtctccataccctaatgacaacttgtgtattggtctcactcgagctcacaatggcagagactgtggctgtgccttcctttcccgtgtttctggtttagatttctcagcaacttgtctctagccccactgaagagacgagagaaattgataaggtacctaaggggacctttcacattgaatgaggagatcaagtagaatccccacaacaggtggttcccatcaaaatggaactgctagaggggacatacgacaacctgaatttttttttttttttttttgagatgtagtcttgctctctcacccaggctggagtgcagtggcacgatttcggctcactgcaacttccgcctcctgggttcaagtgattctcctgctaatcccagctacttgagaggctgaggcagagaactgcttgaacctgggaggcagaggatgcaatgagctgagatcacggcgctgcactccagcctgggcgacagagtgagacttcgtctcaaaaaaaaaaaaaaagaaaaataataagaagaaaataaaagtacacgaatgtagattgataagaatataactgtatttactgacagataacatgattttctacatagataattgaaaagagtaaacaaaaaagttgctataactataaaatgagtttagcaaagtcatgggatacaacatcaatatacaaaaatcaatgtcaattttatttatgtataatagtaacaaccaattgggaataaaaattaaaaagaaaatatattggcaaaaaaccataaaatatttagaataaatttaacaaaatatgtgcaagaccagcccactgaaaattgtaaaagttgttgagaataactaaataagacctaaataattagagagttataccatgttcatgaataaaaatgcttaacattttcagaaagaggttggtaatctttctgtaaaggccagagagtaaatattttaaatttagcaggtcatacagtctttgtcacaaatactcatctctgccactgagtcatgaaagtagccatagaaaatacagaaacaaaatagcatgattgtgtttcataacaacttattggcaggccatgacagctcacacctgtaatcccagcactctcggagaccagggtgggggcaagacttgagaccaggagtttgagactagccagagtcacagagtgagccctcatttctataaaattttaaaaattagctggacatgttgggtcatgcctgtagtcttagctactcccaatgctctgggaggctgaggtgggtttgaggttacagtgagctccactgtactctagcctgggtgacagtgagatcttgtctctaaaacaagtggaagaggaggaagagaaggaggaggaggaggaagaggaggaggaggagtcttcaaaaatactgaatctgagaagaattgatctttgtcctagcatatagtgataaatgttggtgatcattatgaggaaataagatagtctaaaaaacttatttacaaaaacaaaaacaggatgtgggccaaatttgaattgtggcccatagttttctgatatctgttttaaaggtaattaagagaaatgtaaatgtaggataattgtacatttagaagagggaacatctactaacaaaactcacatgtttgcattagttctttattacatatctaaaatatgaattttcataaaatgattctaagtagaaaaagtttttaaaattcttcttttcataaggaattcaaagtcagggataaaaacatttaaaaacataacagtattttattatctcttcaatatgttttcctcacttgagctaatgagtattttataaagtgagactaaaaggacaaccatttttatccctaaatctgctccctccttggaaataagttatcaaaatgtacaaaattcagaattacaccagcaacttgtataatgtagataatttaaaacttaattcatatgagacttttatgtggccaagaaacatatgaaaaaaagctcatcatcacttgtcattagagaaatgcaaatcaaaaccacaatgtgataccatctcatgccagtcacaatggtgatcattaaaaagtcaggaaacaacagatgctggagaggatgtggagaaataggaaggctttcacactgttagtgggagtgtaaattagtttgaccactgtggaagacagtgtggcaattcctcaaggatctagaactagaaataccatttgacccagcaatcccattactgggtatatacccaagggattataaatcattttactatgaagacacatgcacacatatgtttactgcagcactattcacaacagcaaagacttggaaccaatccaaatgcccatcaatgatagacttgatcaagaaaatgtggcacacatgcttcacggaatactatgcagccataaaatagatgaaactggaaaatggatgaaactggaaatcatcattctcagcaaactaacacaggaacagaaaaccaaacacctcatgttctcactcataagtaggaattgaacaatgagaacacatggacacagggaagggaacatcacatactggggcctgtgagggggtgggggcaaggggagtaagagcattaggacaaatacctaatgcatccagggcttaaaacctacatgataggttgatgggtgcagcaaaccaccgtggcacatttatacctatgtaacaaacctacacgttctgcacatgtatcccagaacttaaagtataataattaaaaaaaaaaccttaattcatatgaaagttcacagcagattttggtgccttttttttttttttttttgagacagggtcttgctcttttgcccaggttggagggcagtgacaccatcatagctcgctgtggcctcgaactcccgggttcaagcaatcctcccccctcagcctcccaagtagctgggactataataccggcagacaccaccataccccgctaggcctttaaaaattttttgtaaagatggggtcttgcttggttgctcagactgtctgaaactcttggccacaattgatccttccaccttagcctcccaaagtgttgggaaaataggcacgagccattgttcttggcctcaaatgcttgagaaaaaataaatacatcagtataagagtggttgattttgaaaaataattaatgaaagctatttactagtttacttattgggatttaaagcatgagaattttggattagggaatctgaattttttgtcaaaaattcaaacagtaaaaaagtaaataccttcagagagattacggactttctaatatcttctaaacataaaataatgtagccttcgtttttatgcaaatggactttattaattactgagcacctgtactgtgacaaatactgggtgaggagctatggctaaaaagatcatgactgccatctctttttcttcttccctctctccctcccgctcagtcttaactctggggaattccagctaccatgttgtgagctgctctgtggagaggctcccatgggaaggaactgggagttggtcttcagtcaacagtctgagaaagtaaagcttatcaaccatcacaggagtgagcttgggagaagaccctcccacagctaagctttgaaatgactgcatcccagccaaccccttggctgcaatgttgggaagatggtgaaccagaggtctcagctaagccacacatgcattccagacctacagaaatggaagctattaaatgtatactatcttaagccactaaattggggtaatttgttacaaagcaatagattcctaacgtgtaaaattaggtaagttacataatatttcagcttcttaacttgtaaaatggaaataataatagaaccttcattatgggatggtagaagcactgaagttcttgaactatgtattggtatggcttatagtaagcaaacaacattgttgtgctttctaacattctctttttaattatttaataattttaagattatatggctgtctgtctttcccattccacaagaatagggaccacgttgcaatgaatgtctccactcatcaatcagtgcatcagtggagagaaatatatatatatagcggtaggcaatctgtatgcttaattcagggagaagaatttcggaccaaaggtgatgcatattcaaatcttaaaatatattaccatatttacaataaactgccttaaaaatgtacaaacgttatctccttcagtgctagctgagggttaattttttcctcatacatgtatgctattaaacttttaaatctgcatcaatgctatacatcactattttaatttgcacattttggcggattttttttgtatttttgtttgtttctgtttatagataattttgagcatcatgaatgtattggccatctgtatttgttctttagtaaacagcccatttatcccttacccatttttctactgagcttttgtctttttcttcattttccaaagcactttgggttataaggaagtgtttctatgtaattattttacaaaactctttttttgttctcgttgcttcaatcagaagaggatgttgaatattatcagctagtttttaaccatatattgagataatcatttttttctcctataaaattagactgcatttttaaagaatttggcttttataaattatcaaattacttcttgtggatattgtgttcattagtgtgaggataatagatttattggaagttaaaattaaggaaaaagccttcaacttttatttaagtgcttaaatttgtaacacactttgaaaatcagtaaaggctattaatgtcgttcccaaagttgactgtaaattgagaatagatttagtccaatacacacaacctgaaaactcaaccaaatataggattgaaaaaatataactataagataggtaatctaggccgggcgcggtggctcacgcctgtaatcccagcactttgggaggccgaggcgggtggatcacgaggtcaggaggtcgagaccatcctagctaacacggtgaaaccccgtctctactaaaaatacaaaaaaaaaattagccgggcgtggtagcgggcgcctgtagtcccagctactagggaggctgaggcaggagaatggcctgaacccgggaggcagagcttgcagtgagccaagacagcgccactgcagtccagcctgggcgaaagagcgagactctgtctcaaaaaaaaaaaaaaaaaaaaaaaaaaaaaagataggtaatctaaaaatttcaaattatataaaactgtatttaagaaactgaaaatcaaataacatgctggtgtggtttgaaaaatttacatgaatatccatgtcaacaacacattgttttccttttcttaaataattttcaccagaaaaatgcttgtaattgttgaaacatttatattaaagaatcacaacataaaattaactacaatgctaagtcgtctcaattaaatagcagaaaaggatgatctgtttattcctatctagactgaagtaagtttctttattactaaaaggtcctaatgaagatagaaataaagtttcaaatgcatttaagaaaacattaaatcttttcttcatcagaaaaatgaacctaagttgaagggttattgcatctgaagatctaattgtggttactaaatggaataatagtgaacacactgccaactgattcatctactatgaggactacagttccaagggctagcatttgtttaattggagggaagtagacttcgccagggtttgacagaattatttatcagtcatctactttagattcatctttattctaaagagtaaaatttaacccaaagcatcaatatgtaaaatcctgtaatcttcttagcacaaggtaagcactttaggtaattagctagaagatacaatgtggtaaccagcagtcattaattaaaacactgccaattttctgtggctagcaggggtcaagtggggacaatttcaatgctccgttacatgaaaataaaatgttaaagcattatgtaaggcacatactgaattgctagttatattaattctgggtcacctttcttatttattgcaaatatatgcatagctgtgttcacagggactgagagtatggggacagtggaaaaagaacggcagattgtcaccaaatgagcccactttgaaggcagcagcaaataagaaaattgtttcaatttttttccttcactgttaagtctttgctggtctgtagagagggcacttggataagagtcaaaagggttaggttctcatgctctctgaaactacccatgccttacagcaagtggcttattttctctgcatccttaatttcatcatatatgaataaggagaataatccatttacatatgatgtaggattgttgtgcacataaagtgaagcaagattgtatgaatgtgggtataaatgcctgcatgcaaggagagcttggtcaatgagctcatccagaggggtccccttgtagggtgaaataagactgaagagtcgcaggaccatggaaaggaggtctctttagcctcaccaatggtttgcacaatggtcaggcggtaagctgttctttcttttcaccaaggaatcaaacacaatccctttcatccttatggagagagtggtgttttcctcaagaatgcatttgtttttcttctttaggaaggggggtttcctctctgagaatagttgggggattgcaggaaagcattgggtaaaaagatagaggttgcaatggaaagataagagaaaaagcaagaatagcaacagcagttgcacctaaataaggtttagtagctgaaatacaatgcttattcagtgaaggagtgctgaagagttctgttacaaagaagaatcccgaagtggacagaggtatagtcctgagacaccactggcttggttccaggctggagagctatttccaatccctgagaaagaagcttccaccactgtgcaggtaatatttatgacactgaaagtttgtgtcagatgctgtatgttgatctttagcactaccactttccctctaaactctgccctaaattgcagggcttgaaagcctgaaaactacattccctggctttgttactagattctggtttacattttaccagtgagaggcacttaaaaacaattttgtaggtgcaagggtggaaaagccattattttgctttagaagcagcaaattgatgcatgggtcaaccccaaacatcaggtttatggctgcctgtgggagaactacaaatcactgcttgagcactagaagcagctgttagcagtgacgggagaagcatcttagttcctacacttctcaggtgcttaaagggccgcgcagtttgtccacgcttcaaaggattttgcatgcccctaattccctttattaaatcccttcttgataacacaccacaccatccaggtgtgacaccgtccaggttacttcttttgtaaatgtgcacataattgtgtccactgtgcaatccagtcatctttccttaataccttcatttctatgttgaagaaggctatccaatgacaacaatggaaatttcatggtctagattagtgtctaatcaggatttgttacaacttgctagtccactagcacttcaatgtctaattctgtaactaatacgtaattatgtaactaatacataagaatcctttttttttaaatcagccagagggaattggcccttcactcacttatcagataattgatccatgaactgaacacaattcagcactcgtcaaggggtcatgtgatattggaagtggttgaggtgactcaattatgcagattccaccagtgctttgccttgctcctgggaggagccctgcagcagtgtctaccattcaaggtctccagccaccgtttccctggagcaagagccccccaaacatttgtcttcagtgtgactgcctacacctagaagaaggcttccagaaagtttcccaggaaataaatgagggggaaagatggaggagtgctgaaaaataaagaaaggaagagcaagatgggccccagggttgactgtcctggtggctccaccaaggctcagggtaattacacttccttaggtgaggaccctgcagaggtcctgcagcagctcccagggccactgagatgctgattagggtagcacagaggaaggcaggttttctgctctgctaaggtttttcctaccatcaaaggaagaaaataaaacaatatatggaacactcactttctctgttcagcttacaacttgttttcaagaactcattatttctttgtgaggccccttgtctcttcttggggaacacacaacacacaagcagagctccttttgttgtgcatgagggatccatatcggactttgaacttgggtttatttttaccatgtgtgccatagagagatgttgccttcttctcgtttttggattatttgaattctttccccatattaattcaatatttgcatcttatcacctaattggaaatcggggtgctgggtgagagccaggacttgatagcctggatcagaggagtgcactggggcagagcaggggatcactgctgcttcaggaaatgaaggacatggaagaggtcaaaaccatgggtgtggagtcttggggtgctctaaacaacacagagcaagacaaatggtgagtctaggaatgggcatggtgagagcactgaatagtgtgcagatgcacaggcaggggtgggacagtgggagggcagcagcctccaccaggtcaggcttgtggtcagaagttttattctggtgatccacactaagaggattaagatagggccaggattggagccactggtcccaaggagatgaccaagacaagggtcagagacaatgcagagacccaatttctcagaacagggatgcaaaagagacacttgtctgagcaaagcctgtggaactggcattcaaggtcagagtgagtggcagcaagggcaaaaaaagaatgagacgaaatgccttggacactgaacctgggggcactcaggcacgaggctggcgcagagtgaaacatgcaagggcatacagagcaggacaaagggaccagaacttggggagaagccttggaggacctgaaaactcagtatcatcccaactgggccctatgaacgtgctccctattgagctattttaatataaaccccctgctttcccagaggaaaaacaaaagagaattttatttaagcaaatttctgtctcttgataatttgcttctttccagacttatcttttgaatgtacaacctgcagtgtgttcagcagtgtgatccacaggtgatcctcagtgtgatctgcagtgtcatctgcagtgtgatccacagtgtgatccatggtgtgatctgcagtgtgatccacaggtggatctgaagcgtgatctgcagtatgatctgcaggtatctgcagtgtgatccatggtgtgatctgcagtatgatctgcaggtatctgcagtgtgatccaaggtgtgatctgcagtgtgatccacaggtggatctgaagcatgatctgcagtatgatccacgttgtgatctgcagtgtgatccatggtgtgatctgcagtgtgattgcagtgtgatccacagtgtgatctgcagtatgatctgcaggtatctgcggtgtgatctgcagtgtgatcacagtgtgatctgcagtgtgatctgcaggtgatctgcaatgtcatccacggtatgatccacagtgtgatctcaaggtggtctgcagcatgatctgcagcatgatccacagtgtgatccacagtgtgatctgcagggtcttctgcagtgtgatctgcagtatgatgtgcagtgtgatcacagtgtgattaacaggtgatctgcagtgtgagccctctcttgactgctgaggaagggactgacttggtcatctcaccagagaggtctgaaactggtgttggcagaaaatctgctctagaattaacctgcttgagggacttaggcttgtcctttccctcatatttctcatggtcttctgagacataggccatgaggactacagaaggttccagggatgtcccctggacattgggagggaagttgtgggcaggatcaaggtgagcctttccagggcatgcccctaaagtaggaggggactccagagagggtcacctgagcagtttggccagtattgagcacagcatgtgttttcccctccatcttgcatggaaacgtttagttaactgtctggagtgcctagttttatttctatgaatctctcaacaaaagaatcaagttcctgttgccccctgtgatgagtctataaccacaggggaggatttctccaggtgggctgacactgagcagaagagggtgcttttagggccctagtggtaagggacagccaggccctctgggggactgtgcgtggtgagtgcagaagtgacagcctccagcagcttgtctgggtgcagtaggagaaggaggagctaaagcaaacctgtgtgtgcaccaaataatggtggattctctggagcctccagggaaatatggaattggggaaactacaatgagcagaaaggacacaggaaaaggggcagggagaaatacaatctcaagagagacaggaagaaatagagtcacacaccattgcagcccttagtatgagctacagagtggggaaaatagaaactcctctaaattaagaacagcattacccttgctgggagaagaaagagatgtggacagctacataaggacaagctcaacaaagattggctgtagacagctcttgacccctttccgcccagaaaaccaaggaggacaaaagaaaaccagatgccgtagcttataaaaattcactaccactgacaaatggaaagaatgcaataaaattattaatgttcataaaagaaaaacttggatacatgaaaggactatccatggtattggctgggaagactcaatattctaatgacatcagcattcttcacgttaagctttaaatttatgatcctccaaattttccagattttttggaaacttgataaagttatcttaatatgcatctagaaggaacaaacaaacaaaaatccatgcagaaaaagcaaggacatttttgaaaaataaaagtcacaaggggagtattgtcaaaacagacattaaaatagaaggagataaacttctaatacgtatggtgctgaacaggcaattgagtgtaacagagagaaggctgaaacacagactccagtattcacattttccccttagacaataaggtatcgcaaatgaaaaagtttgggctcttcaataaatggttttaggacaaatggctaaccatgtaagttcatgataatggcaataatgatattaataatagctaatacatactgactaatggctatgtgccagaagccataataaatgctttctatgagtcatcttactaaatcatcacatttatccccttattttatctgtttcagctgcaaggatgctgtggttcatatggggtaggtaatttacatgcagtcacccaaccagacagggttgtattatggctggggtttgaacttatagcccagtctcctaactgatgatttctactcctcctcctagattcctactttatttattttactaaaatcaagtccaaatttaatgaccctttgtatataaacaatagaatttcatatttgaagatggaggcataaaccagcacttcttctcttcctgggaacaacatgaaagcaaatgggagagagaagcctagaaaaatgtaacctctatttcctatgaaattagaaaatagctaaacttccagctacagaatgggtaaatgggcaaccaacagggtaattgagcagaagagcatgcaggaagatgagggaatcagggccaccgctgtgaacttcagaagtcccagcagagtgggtcacaggtgagagccaagcctccatcagtgaaaacagtgtgcataggtgggtgtgggtggcacttccccaggcctgatgtggcttagaattttagaagtagggttagctgaggaatcaggcatttgtacacaacaatctttttctggggacatggattttcttcaaatgtaagtacagtagttccccctcatccacattttcactttccatggtttaagctacctgaggtcaattacagtcttaaaataggggagtatagacacataagatatgttgagagagacagagacagcacattcacatagcttttattacagtacattgtaataataattttattctagtactcataatttttgtcaatctcttactgtgcctgatttataaattaaactttatcaggggtatgcatgtgtaggaaagcgcatagtatatgtagggtttggtgctccccaaggttcagtcatcccctgggggtcttggggctgctgtattcgaaaggaaaccaagacctagcaaagatacaataagcaaaatagaagaaaaaaacagaacaagaaaccaggtattacgacttagatgaagactgtgaataaaacagtcacttgtctataaagccatggctgaagaagggtgaactgtgagctggcagagctggagagaaagaaggagaaaaaatataaactcacagcagtgaaggcagaaccggagttggcacaaagaagaacagaccttgctggggaaaagacatggagaacagaaatggaaaaatatcgaacaaattaaaatggaaatcaatgagttaaaaaaccagagagaaaatgacagctacagagactaggtggcaatcctatggaaccacaatcagagaccctgaagaagaaaattaaagcagggaagagaacacttagagatacaattcatgggaaaaatattttttaaaataacctgaatctacatattaaatagatgcaccacatctatgggaaaattgaccccaaatggaaaacaccaaattatagactaaaaatttaccagacttcagggcaggtgcggtggctcacgtctgtaatcccagcactttgggagaccgagttgggtggatcacgaggtcaggagttcaagaccagcctggccaatatggtgaaaccccatctctacccaaaatacaaaaattagctgggcatggtagtgcatggctatagtcccagctgcttgggaggctgaggcagaagaatctcttgaacccgggaggtggaggttgcagcgagccaagatcgtgccactgcactccagcctgggcaacagagcgagactccatcacaaaaataaaaaaagaaaataaactaccagacttcaaagtcagctctttggtgcacagaaccaaaaagattaagttccttctacagggaaatcaggcagtctgtgctccctccaaggagacagtgtgagccgccaatatctgtcctttgggtgtaaaaaggcaaggaacaaaccattgcaaaccagaaagaggttggaatattcttcactatgtccaaataactcatactgagcacaaaatcaatctaacacagaactggcaattgcaaaagttgggcatatggctgcagaacagaacatagagggtctaagctctgacaatgcagaaaatattcatcaaaatctaggatatttagaaaatttatcattgcttatattggaaattgacagctgtatctgcatagagaggagcccaaaaccctgatcttaccccagccacaggtctgccctcctggagtcgtcctgtctgtcaccggcacttccactatcctcactgcctggggttctccccttttgtcacacccatagtatgtccatcactcaaagacattcagaatccatttgtccctcctccactgcagtcaccctggttccggccacatcccggccaaggccttagaacagctctccggctgaaattcctgtccttcacacagtctgctttcaaaacagcatgccagtgtgatccttttaaagcatgaggcagatcacaccatctctctccaattacccagctagcctcctagcttctggcttcagcacagcagcagctgaagagaccgcatcaccatcaccactctcattgctcaccatacccactccccacttgggcagagccaggtccttacaatgactgatggggacccagtgcaggagtctcctctcccaggacttcctttcactaactctgccacagctgtaatgtcctccttggtgtttctggatcattccaggcatcaacctcccggcctcgccccctacccccaactcttgggaactagctggcccctcaccttccggtctccctcggaggacaggagcacaggactcatctgtctttaagtctttcctcagactttccctactcctggggtattttgacaatgctattttaaatgcaaactactccccattgtcctccagcgtcaccccccaggcatgctctgactcttctttttggacattcccacaaccaagtttccctgaaggtcagagactctatggacagccagagagagcaaaggaggcccaggccaggccccaggctgatgcatcatctattctctcgcatttgcagtccctcttcgcttctcagcaggtaacaaggagatggccctgaactattttccctccagtataagtgacatacatgcaagagaatggcattaagctgtggacttctgggagtacaggtgagacccacctcagaatgaagccctgattttttttttttaaatctcttttaggcaagaggcctcatttgttcatgtaaataaataaatcaaaaaagagaactgaatgtctcagactttgtgtatctagacccaaggtcaaaaatgtaatgactttttttttttttttttttttgtagcaaagattgtttcatttctacaatagctacctttaaactgcagtgatttaccctggaattctgcctcccctgaattaaactgttgcatctctcaaggaaacaagctgaatctgttttgtttatacagttttgtcatttatgagggagctgcacttcagctcttagtgatcatttcattgaaagaaaacatgttccataagcaaggctaaattgttcttaagaaatagatttactgcttgcataattaaaataacaatataccatatttctctatcagattggaaaatgtcaaaaaaaaaaagcctaatatccagtattattttggttataagagacagacactactgcaaactgaggtgagttgtgtaaatgaataaaatgctggcaaattgtcaatacatattgaaagttataaaaattatttactccttgagccagcaactctacttatagaaatttatccccagggataaatgaacacatatacaaagataaatgtgacagaagtcattagaagtcattatgatatctttcttttccttttttttttgagatggagtctcgctctgttgcacaggctggagtgcagtggcgtgatctcagctcactgtaagctccgcctcccgggttcatgccattcttagcctcctgagtagctgggactacaggtggccgccaccacgcgtggctaatttttttgcatttttagtagagacggggtttcaccgtgttagccaggatggtcttgatctcctgacctcatgatccgcctgccttggcctcccaaagtgctgggattacaggtgtgagccactgcacttggcccattacgatatttttctaaaagaaaaactggcaaaaaccaaaaatatgacattcaacaatagtgttggagatatccagttgccaggtatccaacaccccctctgacttaggaaaataacacacattatgtccatgatggcttacggaccctttatagccaggggcgacccggccagcgatccagagagatgctggcaaaattgatctgtgatgcacttctggaaaggaccttaaagggaggtgagtcgtgtgggaggggcagccatctccctttgctcttcctcctacagggaaatgtgaaaggaagttgacactatagcttggtggccatcgtttgaggatgaagaatgctgctaggagaggcagaactcttcctaacacataaggagtttgggtgcctgatgacttagccaagccaacaaactagtcctgagctgtcgacatccagagtcctcttatgagaaaaataaacccttgtgaatttaagtggctgaactcaatcttaactaaagtaattagataaacgtaattattgatgtactacaataaacattacacagacattaaaaagtcacggagttcaaggccagcctggccaacatggtgaaacctcatctctactaaaaatacaaaaaaattagccaggcttggtggtgtacacctgtaatcccagctactacttgggaggctgaggcagaagaattgcttgaacccaggaggcggaggttgcagtgagctgagatcgcaccactgcactccagcctgggcgacagagcaagactctgtctccagaaaaaaaaaagtcatattaagcaccatatttgttgttatggcaagacatacatagtatattgttgactgaagaaagattataagccagcaacaatcatcaaacttttaaaaatgtataatgtgtatctatgggtatgcaattgcttggggacaggactgacagtctagagacaaaaaatgtttgcagcagttatctttgatcatctttgagtgatgttattggggggaatttaactttttaaaaaattgcaatttctaatttttttctttgatgacttgatattggatatgaaatttaaagacaaaaaagctactattacaacctaatttttaagttagtggtaagaagggataaaatgtcagtaacatccaagacagacaaagtattatttaatctatgtagaaacacttccaaataaataagacatagagataagcgtgcaagtaacatgaataagaaatttcccaaaggagaagtagaagtggtctgttaacataagataaaacatgttaaacaacattaacaatctaagtatgcaaattaaaatgagagggcattttcaaccatcaggttgtaaagactatttaaaaaaaatgttatctagttggtgaggatgctgggccacatttacccacccatactgttggtggcctaagtgcccttgggcagtacagagtaagagccttgtatatggctggtgccttttcacttcacttacacatatgcgcattgaattaacatacaggagtgttcatttgctggagtgtttatgagagtgaaaactgtaaacaccctcagggagagagagaacacctgcataacgacaggcattaaaaataatgttgaagaaggcaaatgtcatggaaaatgtccataatatcaaatatgcacttccatagaaactaaattaaatttatgatgtttatctgtttccatgtaataatgcacaatggagcttcaaatacggcaggaaataaaaagtcatgggggcagagactctgaataacaggattttatttttgaagaagtcctttgcacatggacagtggatgtggtgtgtggtgtgtgacaggggagttgcttcagggacttttaaaaatttagctattttcccaatcagacagtgtctagcaaccttccccacttctttaccttccttctcaaaagagagatgccaggagggttgcaacaaatgtaccatttatttttcctttggtcattgttgcttccataatgagaaaatgcaacatgctattttaaaaaagaaagatctagagtataaatgatgattaagtcaacacaaatacaaatacctcacaataattaaacctagatactaggtcttaggttattggaaaaaaaaaaaggtcatgattgactgattatttgatctcaccagtacatatctggccctcaactaatatagtactgaattcaagtgtctaaatgagaaaagaaagagaacttccaatatgtttgcaagtaccgttaaggaggcgttctgaagaagccaccctaatgaacagaaattgtttttccaaagtctaacatgattccactcttcgtttccatgtcatacatttctacttgcataatatctacaatgtcacctaaaacccaggagctactgttctgcattagaagaggaaacatgattaggggtgcaagcagggaacatgagacaatcgcaataggacattgggcgtgtttgtttttaaaaagagcacgccaaggagatgacgtgtaatctgtatattctaaggtaataaggggaataaaacaatcaatgatattatctttaactttctaaacccactcatctctctaaatactggggaaatagttttccagctatgagtagttctgacaatttaaactcacatctcttcatgtacgagtgtgcagtgatctctaagcagaccatggttatgtaatacaggtgggcaaggtaggacttcctaagtgctgaaacaatctacacaaaagacttccatccctctgtggcctttccaagggcatgttatgtacaacagacacgttgtgtgtctgaataaaaacacctaggtggacaactaggaatgtctatgagagaatgataggcttggtggaaacagagatacgtatctacttgcaagaaacttctctggaaatctagaaatgcttatctaatcctttagaacatagcaaatgtttgacaggtaacaagtagatcaagtaactccatacctttagagaatttccacacgatggtaggtacagggtaaccctcagcagaacaattgaggatgactgctttgccataaatcccgtcctggtcccgtggctgaaccacaaacttgggaggaactgaaaagagagaaatgtcaccagtaattaagactagaccagaaactgagtaaaggtatgattctaagaaactgaatcattttaatgaatattaaaatatgaagactgtttcatacacatgggacaataaaaacactattggcagtttgggacaaattaagggagtaatttcagtgctgaaaaattttctgattcatatcaatgagcttttgtcacaggtaaaagccctttgaactagggaaaactggcctcgagggaggaagtttgactaaatcaaagggatggaatattttgcttttaattgtgttatcaaaaatatacagaaattccctcaatggaaaattgaatcagaatcaccatttaaagaacagatcaggctgggcgcggtggctcatgcctgtaatcccaacactttgggagtccgaggcaagcagatcacctgaggcctggagtttgagaccagtctgaccaacacggagaaaccccatctctactaaaaatacaaaattagctgggtgtggtggcgcatgcctgtaatcctagctactcaggaggcggaggctggagaattgcttggacccgggaagcggaggttgcagtgagctgagataatgccattgcactccagcctgggcaacaagagtcaaactccatctcaaaaaaaaaaaaaaaaaaaaaaaagtagatcaaatatatatttgtgcctcaaatagtaattatcaaatataagtattcatcttggatgtgaactggtcaaagtattcgatgttgatttttcctctaccaggagataaagtgagaaataacaggcacctcgtaaaggcaatcgagaatacaatgtgggactgaacttttcccaaaattctggtgagaacacatagtccgttatgccagatgtcagcaccacggtgggccaaagggggactgtggagagtagttgcagtgaagtaccataaaggttttctagtgtgcctataaaaaacaagatattaagtgactgcttatctggtgaatgttgtgaggtgctgtaaagaaccatccctacctaaaacataaacatgatttcacttaaaacatatctccccaaagaaagcatattttttgagataagccattaggattttaatatgtatcacatctcttagaaaaggtagcatctgaaagtattctaatccccgtatctttcccagcagatcagcgattcattacagggtagactttcagtgaggcagtcataaactatgtgagaagagatgaattatctacaccatatagtagatacttagaaattcctggtaaggctaatctcatcagccttgcaagatacagaattcttaattttgagacataaatgtgagcctatgtgttacaggtagataggaactcagctgccacatatgatagactgagaagatggttagggcctaagttagcaaggggcttagaagcttgttacaatgatctgagccaacgtgacgatcgctttggccataaaataacaaaggaggaagggaaaatgtcaagacacaagaagcagccagagatggaattcaccgcagtgtttctggagaaaatattgcttttaattttctagctttactttctgtagaatgatttacacatgaagaagcaccagaaaataatgactaccagcataaagccaagtgttaaacacattggcttggtgtccagcttttctatttcctgttgggcaattttgtgcaaactgtaaaatggctcttggtctcaatttacttatctgaaaattggagatgattatggaactcattttaaggattgttaagatgatcaaataaattaagattagaaaagttctcagaactgtggagatattaactgctgtaagagtgttgattaatttagtaaatgcaggtatgtttagcttttacttttttttttttttttgagatggagtcttactctgttgcctaggtggagtgcagtggcatgttctctgctcactgcaacttccacctcccaggttcaagcaattctctgcctcagcctcctgagtagctgggattacaggtgcctgccatcacgcccaggtaatttttttgtatttttaatagagatggggttttaccatcttggccaggctggtcttgaactcctgatctcgtgatccaccagcctcagcctcccaaagtgctgggattacaggcgtgagccactgcgcacggcctgacatattcttgatgagcaaagttcccaacttgcaaatgaaataaataatttacacagccaatgggtttctgagatattgcttaagtgataagcaatgttacttcatgtagatggtattcggagacaaaatgtatttaagaaaatgaaaatatatttaaaataagataataaggaatgactatctctgagtgaggaaattatctctaagaaatatggtagagattatttagagctaagttttctagtaaaagtgaccaatcaactcaagagcaggtgacaaagttgaagacaccatgccaaaattattctctgcagggtggaaggaaaatctgcagccatccacattctgtgctccatttggctcaagttctgccaagagcaagaaattgctcatcaatggacagggtagaaaatctcttgcattccctctggaagcatgtctaatcataattgatccattactcctcccctcaatttggttctaatccaacgaaatgttccttaaaatctcatcaaagaagtgtatatgagaaacaaccatagaaatacggtaagtataaggtagttacagataaaaacggtccctaaattagtagaataattaccccgtatcattgaaaactgtttctgaccctggtaggagtagccaggggatttcccacgtacacctctttgctcatagattggaattctctcttcagataccccagtgatttacagtcacatgaagacctaagaaagaagcttctgcagtaagtgagcttcttaatttttatagcaaagagaataattaatagctcagatgtttggtctttggctgatataccatgcaacttgagaccaccttgaggaaaatgctatattttactaagtgcatgaataagccaaatcatatacatttcctttaaattttgacagaagactgtcatgaatgtaaatattcaatccctaagtgatttattatcgtgtaccagtgaatacgtaggtccctttcatgaaagtgaacttgtgagttacaataagaactctaagactgggaacatccatgtacttacatcaagaagacctgaggccacacccctcagatctgacaccttaagaatatgcttgggttgagttctgcctggcaaaattagaggtgatggattcctgggaaaagtagtaataagtttctaaacaaatttctttgcctgcccagagcctaatgtgaagacaacaggcatatggtcccctgggggttgtcatcactttgagacagctgcatcaccagctaagattaaaattccagggcaggggagtgtctgaatgaggacccagtgtttaacatgtaactaatgacatcattctcatatgctctaagcatatgagaatgaccattatccctagggacaacaaagttcccaattttttaaagtaagcagcagtttattttttaaaaagtgcagatattttttaaagaaactattaatattcgacctagatactttttttctacaaaatggcagcctaagaaattgtcctaaaagaatcaggagcccccacaaggagtcacttagtaatgaaagtgagcatttcctgagtactcagtgggtttcacgtactcctagttccatcctttgacccctcccagaattgccctcaagacaattcttactttgcttgcttattaaagagaggatcccccactgtggccctctccttcttctcagggtgttgtcttcaatcttctccacatcttactcaacaaacctcctgagctatttcacccactcccatcacgatgattgcctttatcttcccttggtgtgtagagcaccatatccttccatcattagcttatatcacaggtacctctaattcaagtttccaaaatggtacctgttcctgttcaccatccattaaggtcctcaaaaaagaaaaatggaatttcctttcatatcctcttctttcatttctttttatcaggtgctgatgattatttcttgaaaatgtatcctcaaattctctgcatctccactgccacaccccagtcacagtgagtagtctggttatgtgggaaaggggcacagcccctctgtccacccggcttcagcacctctgggaggacagctccacctccacacactttgccaggacactgcactaaggggatgcggccctctctttgctgtctcaggccttctcagaagtcatgagcctttacccaccttactggtgcaaccttgacatgtgaaaaacaattgtccatcactgagggacaggagtcagggtataaattctctgcctctgcctcagtttcctccgatccagtggggcaattatgaggcctgctctgtgcctgcgcttctcaaacattagagggcatcagaatcacctgaagagctgattaaaccacacattgctaaaccttgtctccagtgattctgactcagtacatctggggtggaatccaatattttgcctttctaatgagctcccaggtgatgctgaggctgctggtacagagaccacacttcaagaaccactgttctacgtgattccttagaaggctcccagtaggaatgagctccagttgcccatagcagcaaccagctcattaaagcaacttttactgattttcttttctccctttctaatctcattctttccattctgggatccaggaatgacatcccaaataaataacctgccagccaattctgtgcctcacactctactttcaagggaacccaacctaggacaaggcccatattgcctcttatttagatttctcagccccctaactggtctacctgccacgaactgtcccacttgaattcattcttcactcagggacctaaaggatctaagacacaaattggatgatgtgacttccttgcttaaaagcatcgcatattcccatggccctttggtataatccagactcttgggatattttaaaggatttttatgacttgagcccttggtctccagttgcattctgtgacattctcctcttgcaggctttgccccaactattctaaaaccccatctattatccagtccccaagaccattcttgctgctgggtcttcacacaggcttcttcatgtctgtttaataagttcccattcaccatttgcatcttagcttagcactcactcagtcaggcacatttgtttctgatgctgtggataagattaagtgcttctctgaggccttaattacttaccatagcctttattacgctcatctggtattgctgtttaacagtctgtgtcccataccaggctgtgcatgctatgagaacaagaaccattcctttctcacaggccatggcatgcccagcgcacagcacagatctgcagtacagaaagcactctgcaactatgcgttgaaaggacacatgaatcaatgaatgttattacttcagttttatagactagggaaacggagcatggctaagttaataacgcagatcagggtgacccccaaagcctgaggtctttgagaagagtggacccaatggaagtgccatctgagggacagcagaagacagcctcataggaggactctggccaagaagatacagagcctgagatggaaggatgtgaagcctttgggactgttgccgtttgggccaaaacttatgacagaacaaaaagaccaccagtactctatattgtctgggtgtataattccccaaggttgttggtttccttttttaaagatgatatttagatttccttttattagtataacacattatttagtatattgtggtgagccggcttgccaatatagtttgttttccaatagatcatgatatggtttggtagtgtccccacccaaatctcatcttgaattgtagctcccacaattcccacctattgtgggagggatccagtgggaagtaatttaaccacggggggcggatctttcccatgctgttctcgtgatagtgaatgagtctcatgagatctgatgattttataaaggggatttcccctgcacaagctctctcttgcctgccaccatgtaagacatgcctttcacctcccagccacctgtggaactgtgagtccattaatcctctttttctttataaattagccagtcttgggtatgtctttatcagcagcataaaaatggactaatacagagcggtttttctggtagggaggaagagtaattaaagagatgaataggttcaactacataattacatcacatctccaagatgcaatatggctaaacttgccaaacacttctctgaatcataattacgtgcacataaccagcactcctgtctccccaaaaagaacaatttgatatatattccaaaataccaaaatcttgtcatgggatccacataggctgagagtatctgaagtttcaaataggtttctttgaggaagtttactcctggtgttgcctaaaatgaaggttgtttaaaacacagaggtctttggcttgatctgcttattttgtgtgtgttggtggggggtggattacttctgttgtttcatttttaaagaaataatactatggttataataagacaggcatttttctagttttaaatgtagtccagcgttttatgtttggaagccatggcttctaagttgctatatatttccaaagaatgaatttaggtttccctagctgtaaacctgggcagaaattcagttttaatgaaagccatttggtggaggtgggagggggtgcatggataaataccaccattctctacttggtgacatttagttgagatgggacttggccaaagtctaggtaagatttaatttacgacactgacaattaaacctattgctttcccatcattctgagaatagatggcctggcctctgcttatatctctgccttacactttctgtcctctcttacttaataggaggcaccttgggcctcttgctgggctgtgaacacacaaaactcactccacactcagtcttcagacttgttggtctctctgcttggaactcgcttcctacaattccctgggacgtacgccttcacttcagtcaagtctctgctcaaagatctctccagaaagccttcccctgcccagcctacctaaaatactattttcatccccatctttctcaatccacgtacaacatgtttatttttcatagtccttgtagataactgacattgtttgttcattatctcttcccttcactagactttgaaccttaatgggcagagacttggtgtctttattttaatcaccatggtatcctcggcactcataacagcacctattataaaacaaatatttaagaaatattttgtgtaagaatgaatgaatgaagtaaaatcatagcatgagaattctatcaaaaattggatcaacagatggcaataaaatagcaaccttctatgattttcatttttcctgtcaactgacagtcaactattttagccaatgtgcttgtttctctatgtggcagttcaccattaaaagccagaaaccattgacccatcagaagatataaaaaagtgtgagaaaacggccctcctttggaatcacagataggaactgttgtgttggtgctttcctgtgagtggtctagagaccacaacaggaagcaaagggcaggagtgctctttcatgaagcctaatgcgttatttctaataccttaatcaatgccaaggtcactccactgagcaggatatcagggaaaccatcagtccactgtcataagagctatgagatttggctcttattggctcatacataacagctaagagatttttgcttttggggtgttgtttttgttttcttatattttcttcaagacaacagctaatttattttagatcaagtctttacaaatcttcccactaacccaggctatcaaacaatgtgctaagctttacaatgaccccaggtcaaacttttcttatgcagcttcctcacgtcactcagccttcatagaagagagttagggccttgccctgtatcaagcttgtacttaagggaatgtggtggctggtttggttttctctatccatactatttaaacgttctccatattagcaacgaggttgtttcactttaccatttgtgtgttcactggagtagcatttttcattgccctcaagaacttttcctttgtgtttacaatgtggcaaacagtttggcataggaagcccagcttccggcctctcttggctttcaaatgccttcctcactgaatgcaatcatttctagcttttgatttaaagtgagagatgtgcaatgaatgattcctcctctcactgaaacaccggagactgttgtggggccattcattggcctaatttcaatattgttatgtcttaggaagtagggaagctgagaaatggtcaatattgttgtcttaggaaatagggaagctgagaaatggagactgggaaatggttggttagtagagtggtcagaacacacacaacatttatcgattaagtttgccatctcatatggctactgaacaattataatagtaacattataatagtaacaccagagattactgattaccaatcaccataacagacataataataatgataaagtttcaaatgttgcaagaattaccaaaatgtgacatacagacacgaagtgggcacacactgttggaaaaaatggtccccatagacttgctcgatgcaggattgccacaaaccttcaacttgtaaaaaatgcgatatctgggaagcacaataaagcaaagtgtggccgggcatggtggctcactcctgtaatctcggcactttgggaggccaagtggggtgcatcacctgaggccaggagttcgagaccagcctggccaacgtggtgaaaccttgtctctactaaaaataaaaaaattagcttggcatgttggcacatgcctgtaatccaagctactcaggaagctgaggcaggagaatggtgtgaacccggaaggtagaggttgcagtgagtggagattggcccattgtactgcagcctgggtgacagagcaagatcccgtctcaaaaaaaaaaaaaaaaaaaggaagaaaagaaaagtgcagaagctctttagtttaattagatcccatttgtcaattctggcttttgtttccattgcttttggtgttttagacatgaaatccttgcccatgcctatgtcctaaatggtaatgcctaggttttcttctagggtttttatggttttaggtctaaggtttaagtctttaatccatcttgaattaattttttgtataaggtgtaaggaagggatccagtttcagctttctacatatggctagccagttttcccagcaccatttattaaatagggaatcctttccccattgcttgtttttctcaggtttgtcaaagatcagacagttgtagatatgtggcgttatttctgagggctctgttctgttccattggtctatatctctgttttggtaccagtgccatgctgttttggttactgtagccttgtagtatagtttgaagtcaggtagcatgatgcctccagctttgttcttttggcttaggattgacttggcgacgcgggctctttttttgtgccacatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagcggtttgtagttctccttgaagaggtccttcacatcccttgtaagttggattcctaggtattttattctctttgaagcaattgtgaatgggagttcactcataatttggctctctgtttgtctgttattggtatataagaatgcttgtgatttttgtacattgattttgtatcctgagactttgctgaagttgcttatcagcttaagaagattttgggctgagacgatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtgttttttgtctttggttctgttatatgctagattatatttattaatttgcgtatattgaacaagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgacgctggcctcataaaatgagttagggaggattccctctttttctattgattggaataatttcagaaggaatggtaccagttcctccttgtacctctggtagaatttggctgtgaatccatctggtcctggattctttttggatctaattaaactaaagagcttctgcacagcaaaagaaactactatcagagtgaacaggcaacctacaaaatgggagaaaattttcgcaacctactcatctgacaaagggctaatatccagaatctacaatgaactcaaacaaatttacaagaaaaaaaaaacaaccccatcaaaaagtaggcaaaggacatgaacagacacttctcaaaagaagacatttatgcagccaaaaaacacatgaaaaaatgctcaccgtcactggccatcagagaaatgcaaatcaaaaccacagtgagataccatctcacaccagttagaatggcaatcgttaaaaagtcaggaaacaacaggtgctggagaggatgtggagaaataggaacacttttacactgttggtgggactgtaaactagttctaccattgtgaaagtcagtgtggcgattcctcagggatctagaactagaaataccatttgacccagccatcccattactgggtatatacccaaaggactataaatcatgctgctataaagacacatgcacacgtatgtttattgaggcactattcacaatagcaaagacttgggaccaacccaaatgtccaacagtgatagactggattaagaaaatgtggcacatatacatcatggaatactatgcagccataaaaaatgatgagttcatgtcctttgtagggacatggatgaaattggaaatcatcattcccagtaaactatcacaagaacaaaaaaccaaacactgcatattcttactcatgggtgggaattgaacaatgagaacacatggacacaggaaggggaacatcacactctggggactgttgtgggatgaggggaggggggagggatagcattaggagatatacctaatgctagatgacgagttgatgggtgcagcacaccagcatggcacatgtatacatatgtaactaacctgcacattgtgcacatataccctaaaacttaaagaataataataaaataaaataaaaaaacacaacaacaacaacaaaaaagaaaagtgtgataaaatcaggtgtgcctgtgtttattgaatgcagtacattgtggatacgctatgctgttgggggtctggattttgttgtcttcctttttagtgtcaaatattgtttatgcacacaattaacttactagtggagaagttttatcttgccaagaatcttcttaggctcttttagggctggtctagagtaacccttatgctggggatagattagtcctactcctagggtgtggcattcctgagattgcggctgaattcccctattctggctagttagaactccagcattcccaagcaatgtgcaacttctgctagcaccctgtgcatgtgaagaacagtattcagctgaaactgcaaaggagccctgtacagatttctagagacctttctttgaatagctccctaatctccagtagcttgtccttcaatacccagtaatcatcttagtatctttcaatttctctctctgttttctccacctgccaagatcactgtgatctatttgggctctgcactctctgtcatgtgcagaaagtaccccaagcagctatctggggtgaatttggaactgacttcatgcactttgttttgttcctgaaagcagttcttatatatattagaccaattttatagttggtttgtagtaggaggataaatgtgttacctgttactctgtgatggtcctattagataatttttgtttttccacttctttgacccaaaacatcccccttccctataattttcaatcatttctgttggtgctacctactggagcttcacaccatggttgttattatactactttgaacgtactactgcactggtacaaagaattctggttgcattcactaactcaaggactttgatcctgtaataatctcctctttatcttgacacatatttttttcctctctactggcttattctcataagcataaagcaggctgtaaagtatccagtcttaaaaataactcctgcccttgccccatgtccatttccaactttgtctccattttactgcctcctgtgatagcaaaattcctaaaaatataaaaatagttgtgttttctgagttcctgcacattgaccttctttcttttctgaagctcctctaatcaagccctcgctgcaatgacaccaggtcataaacaatatccatcaaggtcataaacaatatccatcttcctaaaccagtgaccaactcttggttttcctctttgtctactttcagcaggattcaatactgtttaatattctctttctcgatttatttctgattttgcttctagagtgccacagtccactggattttctcctcctttacaggctgctccttttccctcttcgtctcttctgctgattcctccttctcttattctggggccttaaatgctggagtgccctagtgactgctgggacaggtgcttctcccatatcattgaccattattccccttgtcaataccgttcttcctcatttcttctctgcttctgctaaagacactttcattcaccttgttattaggcaaagcatgattccactaaaggttcttctttatctcatttgcaacattcactccataagcgtgttttatttgctttaccgccaaaatagattgtgaattccactgcttctcatgaccttaacattaacaccttcatccaaggcatttttatcttgtctgaatgtctgaaatagcctgttaactactcttcttgctttctagcccagtccattcttcagacagctactagtgtgacaactaaaaagatcaatcaggccatagtgctgtggtggttaaagtcaacagtgccaactctttaatctagaagaaaatccacacctcaaaatggctgcacgttctaattactcagggggctggaactgagacttggctacatattagaataaacctgtggattttacaaattattgatgcctgggtcccacctccaaagatggttatttaattgacaggagcttcatcctggtcatcaggacctttttagacctccctatgcaatctgaatgtacaacaaagtttgagaaccactaactagtgatttttgggaaaaaagaacaattccccagagatctggaagatggatttacccctaaagattatgatttaattggtgtagattgggaccaaaaaatgcacatcagtgttttcttaagcctcccaggagattctacagaactgtctggattgagaaccacagtcccacatcaccttgtccctgcctgtttctccagtcacactgacctgtttgtgaagcacattttcttcctctaggctgcattatctcactggtgatttaatattaatttaactaaagcttatttaacatatttgaagaacaatcacatggagacatcagtcatatcatgatcagctacattatcccaaatagctaggctcattttcagctcatctgattttgccttggttaaaaacttctggttgccttttctgcaagggcaagttgtacaaaaagcatccccgtacatttttatctgacgtttcagattcctggcctggatccttcagagcagattatatagaaagcaggctgatgtactattttgcccttcacaaacccaagagttaactctgcttataagaaaacgcttgggaaacagatactaggttggctcccttttttatttatctttcaaaatttgggaaaaaatcaagtatcccaattcttccactccaaagtgcaaggtggaaatgagaaaaatgtcatgaggctgctaagtttgtgtctaattgaatatatattttctaaattattcacctggaaattttttttttcagaaatacaaagttagtttcttcctatgacttctaagtctgtgtcacttccttttgctggcaggtagataaaaagtgcatttcttcccagctggcaaggaagaagaggtatcaaggggacaaggagtaaggaatgaagaaggacatgagaatctcctgctcaagaaagagctatctccactctctgggaaattacagaaatcctccccctcctaacaaccactctgggaccacaatctggggaattttaaaatgcaaataatcattgttaatataaatctttaacttcagacagttacttttgcaatgtggatgaatattgtaatggtagattaatgtatagtactcttggagaatcataaacatcacagaatgtctgtgtttgatatacattagagaacactagcagcttatttcatagatgaagagtgtgagccttaatgggaatttggtgacttgaatagaagttcaaaataagactgaagcttacagtttagatgtaatgagattactgccagttttctacaagttagcctaccctattttaatttttttgaataagtactaccatactctgcttaattttaaaacgttgcaatggcgtcccaaaataatgatagatttaatgctaaatagaatagatgggcaaagaaaaccacatttctaaaactaaaacaaacattatgaaaagctatttcatggctctttagaaaaactttgatacatagctttgagacatattttttaaaaaaccatttattgaaataagaaatactaaaaatattatatgaatacaataaagcaaaagctcacggacgttagtcctcaaaactcattggcttagcatacggaagccttatttcatgaattaaatcctatggttcccaccttcttagctattaattatttaaaacatattttaggtaaataaaaccttatcttggagtttaggggaattcatggttgggtttagagtcgtatttttttttttttttttttttttttttagtgagataaaactgaatttctaagttccagttattttcgaaatatttcaagccccatcatcttaaaccattgttaaatcaactctacagatgccacatggctcatgatcctttgctcacctctgacaatcaactggctttggtgctccacagcggcggcctcattccgggctatgcaggtgtaattcccattgtgcatgagcgagagattggaaatcctcaaggagctcgtgaagtcaatattgtcaatggtcaccccaaggctcccagggattggccggccatccttctgccaggtgatcgtgatgggtaagtcccctgagaccacaacacaggggatgaagacccgctgcccaatggagaatcttggaaactcaaagggttgtatgaaaggcggaactgcaagaaaaaagaaagataataacgaactgtgcttattctacatttgcttttcctttaaccctgtatacggcactgaaagggtagtacagacgatcatagatacagcatagaaatacaggaactgtagcaaatttgaaattctgcttctattatttgaatgttctcatcattttaaataaaaaccatggttcaatttgtacttcagcaagttaattttgttcaacaaactttaatttaaaaattatttttgaatgaaaacatttcagactatatctgtagtgtaaatagtgtgaaagagggatttaggtttggttttccttcaaagccttttaaaatgatgtatacaagaggaggtttctttcctactttgcgactatgacactacaattactgttccccttctaattgtttcctgccttgtaaataggcatattctaaacccactgaagaagcagaaattccaattttggctggatgtggtggctcacacctgtaatcccagcactttgggaggccaaggcaggaggaacacttgaggccaggagttcaagactagcctgggcaacataacgggacccccatatctacaacatttttttaaaaaattagccaggtgcgatggtgtgcacctctggtcccagctactgaggaggccaaggcgggaggatcccttgagcccaggagttcgaggctgcagtaagctacgagggcaccagtgcactccagcctgggtgactccagcctgtgtctaaaaaactaaaaaaaaaaaaaaaagtaaaataaatattccaattttattgttaaagttctctgttatgtccaactaataacaaccattaattataaattcttatttcatattagaataactacatctttactttgcatctcttagttttgcacactttacgtgtgtaacttttaattgtgaactggtccgtggcaggttatttgacttgctgatgtattgctaaggaggtcgggttatagccttcagcctggcctgccatggacactgcaagcaaactcagcctggaaagctctttcctgattcagctttgctgagtgatgcctgttttgtccaccttgccttaggaactctcttcctcagtgccctcctagatgatgtcatagggtattaacattctgaaatagttaaaatggagtcagatgaaccacatttgaactctaactgttacttgttagttatgagcaaagtaatatgctctttcatcagccttacggattagttatttattgctttactttgcagatgggaaaagtgatactcaaagatgttaccttgcccttttggtcttagaactagttaactattctcggagggcttaaatcatgtcaatataactaatatcagagcctgtaatgtaagccttttttgtgtttttgcatacattcttggaaagaaaaaggtttatttgtatgcaggggcttggaaatgactaagagtacaaactaagatgattaatcatgtgataatctaatataaaccaattattatattacgagtttttcctaatgaagttattaaagatttctacagtttattcaacaattgtaagtccatttcaactatcagcttaaggaagaggtaagggatccggctgagaaatttgaatagaaaaccattcattcatttatttgttcattcaatcaagtcatgtttattgagcacctgggatgtgtgtggcagcagtgaacgtgctgggcacacagcaatgagcataacccatcagcctctgccagtggagcttccatatatagccataggccgcagacagcaaggaagtgcagccatggcgcttctcttatttcgtattatcactatgacggctgtctgctttcaaaagcagttgggagctagaactcaaaattgcaagtacagccagaggtcgaagaagtaggtagctcaagttaggttttaccagggaaattaatttttttaaatggtcaaaggtaccgacaagcatactcaatgtcaatcctcctgtggattctccatgtaaagttagatctttgggattgaaaagggctgatctgatgctaagagataaaggtctcaggatgagattctatccagtgctggtggagagaatcgggtcagactgaggtatgaacgttctcagttggaatgtgctggagaaaatgtcatgttgtaccaaaggtgcttgtatttctttaaatctcttgcccccaagtggcataaatgctcactatatatgtaaatattattaatactaaattgctatgctttattaaagaaaataattacatttcctcccctttgatttcctggacacaaaaacctggttgtcagcatactcagacaaaccttggcttggtgcttactgtctgaattacagacaatttttctaagataagaactttggagccaggctactttggtttaagttcagctatgctacttactacagttacttaacccctctcagggtctcagtttccttatttataaaatagagtgctgccttgagctctgaatgagttaacacagtaattctcaaacttagttgtgtatctgaatcagtttcttagcatttgttctatttcacaagcctttaagatgaggaaaaaacaggtaagttgaaaggttactgggctaattttctctatcagttacaacagggagaaggaatacgtgaggatttactttctccaaatcaagaaagaaaggtaagacatagcatattttttaatctagctatttaataagaaggccgggtgtggtggctcacgcctgtaatcccaacactttgggaggcccaggtgggcaaatcaccagaggtcaggagttcgtgagcagcctggccaacatggaaaaaccttgtttctactaaaaataaaaaaaaaaaattagccaggcatggtggcgtgcacctatagtcccagctactagggaggctgaggcaggagaattgcttgaacccgggaggctgaggttgcagtgagccaaggtcatgtcactgcactccagcatgggagacagagcgaaactccgtctcaaaaaaaaaaaaggaaaacatagagtgtaggttgtaaataattgtaaagtattagaatgtccctttagagcataagagagttatagaatacaggaaatatatgcacatacaaattttcaagaacagaagtaagaggtagctatagaagaatcagcattaaaaccaaaacgaaaaccaaaaccctgtgttttctataattccaaaatatttgcaattcatcagtgtatggtatttaaggaatatttttatcattactttagtacaaagcaacagggctgaaaatcaagaagtacacttccaaagcactgaaaaaccagtgtcagaaagctaatgcactaaatctcatacacatcactccaaggataatcccttgctttgaacatcttattttaaatcattacaacactgtcagttatctgatatcttggcctaaatcagattctgggagttcaggcatattgaagagggcttagtaagaagccacaattggcaagcaaaaggaggagggtgagaaactaaaagtaaattataaagaacagacacaaaaacgcaacacacacagtagttggatgacattttgtttgggagcacattgcccttagtagtcagcatttttgtaattaatacaaaatcgtaatacttaattagcattctgaattataagtcacggttaacatattaaataaaaagatacatttaaaatattttaaaacatatctaccaaaaaaaagcctttccaaaatggttaaaataaatattaaagaaaagtttagtcataaggaaaagcgttttcccagaagaatgtcaaaattaggtttgctatgtgttgctttgcttgccacattatgtaaggacacattaggtcagtatgcacattacatcattgttaatgtaaattaaatcacaagacctatttgtcaatcatgtcaattctttcttcactgcttaagttgccttgcttgcatcagctgtgagttgcaagtctgctgcatacaaatgcataaaatttttaaagcgtcttaagccttatattttatattcataagacataagatcgatggcacaaagtaactccagtgattagaaaactcttctcatgattttgggaaagctgaacctcctatttgagacacactgattacctgattcatgatatcacctaaataaggtaaattatctgaatcttgctgacagtaaaagcttgtatatcataggagcagaaatcctgaatatgacacacaccgcttttgacataccctttctacaagaagtacgtaaatatctgataaaggtcatttattaccaggcttgtgtatttcactctacataatggcgggggtccttttcctaggcagctcagagccattgaatactgccaaatgtcaattttgactcttactctatctaaacccttaacaagaatattagatcagactgatatatttctgtcttgtctcttaaaaattaattgtatattcttcttcatggagggaaatgctttgatttctcctagagaagaggcgtataagactttgataaaatcatgggtggggtgctcgtcaattctgggtgattagcagtgttatcttgatccagtttatttagctctgcgattctatctcttcatgtgtaacgaggtgataatgaaacacagttcattatcagcttgcattgaaatagacagcaagtagctcttctgcgcagccacagggctatttactgtccagttcagtgcaaggcgtgactccgaaatgatgaggctgtgagcaggtgggagtttctagtccggggtataccttcaagatctcctcacccataagtctggttatctggtcaattctgctacttaacaacatcgtttagctaaattttagattactgacccagtctgatacagttctccacaatgtacatacaacacaagtaagcggttcctctactcactcttgttcaaaactcttgtatggaatttatcacattgatgactcaagtgagtacagtgatttatggacgtgcccattttcttaagtagagtgacccaggagggcaggagatctatcaagtttatcttttttatttcccacaactagtgggataaatagtgtcctgttctttttttttcttttctttctttttcttttttaaacggagttttcactcttgttgcctaggctggagttcagtggcatgatctcgcctcactgcaacctccacctcccgggctcaagtgattctcctgcctcagcctcccaagtagctgggattacaggcacacgccactaggcttggctaattttttttgtatttttagtagagacggggtttcaccatgttggccaggctggtctcgaactcctgacctcatgtgatccacctgccttggcctcccaaagtgctgggattataggcgtgagccaccgagcctggatgtcttgttcattttgattgaataatgttttttagaaaaaaactttcagaggtgatgatgaacatatgtttacactctgcactttagacaatcctgaagtcattaagaatgacttagtttactgagaatgatgatttccaatttcatccatgtccctacaaaggacatgaactcatcattttttatggctgtatagtattccatggtgtatatgtgccacattttcttaatccagtctatcattgtcgcaaggacaaaaaaccaaacaccgcatgttctcactcatagatgggaattgaacaatgagaacacatggacacagcaaggggaacatcacattctgggtactgttgtggggtggggggaggggggacggatagcattaggagatatacctaatgctaaatgacaagttaatgggtgcagcacaccagcatggcacatgtatacatgtgtaactaacgtgtacattgtgcacatgtaccctaaaacttaaagtataattaaaaaaaaaaaaaagaatgacttagaaaagaggagcaggcagacacttccaggacttaataatgacgacatggcagggacaagagtgaagctcctcttcatagtcttattagcctaggggccgaggacttctaactactgtgccaactctcccctctgctggcagggccagttggggagcttgagtcaatatctggccttgtttatttaggtacggtcctcgcgccaactctgaattgctatgtgagtttgtttccctgagatcggtgacttccaaccagcagcagccagagatgcacctagcttaccgtgacttaggctgctggtcccgtgacctgcacctgctttagcaggaagggcaggaggccaagatgcagagacatatgatgagggagtgataaggatattgctggagccggtgggtgctaaaagaaaccagaggctgcgtgggtcacatcaacttagattccattagtttcccttcttagcctctcactccaagctccccgcggggttcaatatgagctgatattaactgacattgacctaggcgaaaaaggcaagagtgagccagtggggaattctttggccctgccttctgggtgggaaggacagggaaggacaaggcattgtccttgcagtgtggtggagatgacttttaggatctatctttaaggtttccttaaagaactgtgtcttgggcatatttgtaatagcccaaatcatacaaaactttaaaaaatgtttcaagtatctgtttttctctagacatagatttgaaataccacatttgaatttctgtggatgaatgaagtaggagttttgagtatattttgataaatttacatcttttgaattatttaaggtgtactcaaatgagaagtatacctcctttaggggaggagttataagtaaaaacagcagaccaaagttttctctggccacattctccattctaagaaaacatgttccccatggacagaaaaaaatagctggacccaatcatccatgtcttccttagtttcagaaagtgtcaaggcactgaacctgctgtgacttggagaaaacaaacaagaaaggctaaataatgttcgtgtgtgcatgtgtgtgtgtgtgtatgtgtgtgtgacattctctttatccattcatctaccaatggacacttaagttgtttccatgtcttggctgtcgtggatagtgctgccatgaacgtgggatcacaggtacccccttcacagagtgatttcatttcctctggatatacacccagtagtggaattactggattatataaatttttttaggaaacttcctattgtttcctatcatgtctacactaatttacatccccaccaacactgtacggggttccattttctccacacagccttgccaacacttgttatcttttgactttttgaccacagccatactaacaactaaatcatgcaggccaaatttcacaattctcactcagagtgggcaccaagagattaaaggtggtaaaaataccccatggaatactttgcagccatagaaaggaatgagatcatgtcctttgcagggacatggatggagctggaagccattatcttccacaaactaatgcaggaacagaaaaccaaacactgcatgttctcacttataagcgggagttgaacaatgagaactcatggacacagggagaggaagaaagcatgtgaaagcatgggtaaggggagggaaagcatcaggaaaaatagctaatgcatgctgggcttaatacctaggtgatgggttgagaggtgcagcataccaccatggcacacatttacctatgtgacaaacttgtacatcctgcacatgtaccttggaacttaaaattaaatgaaataaaatagaagaacattatgtccgctatagttactgatgtgataaaaatctttcctcatattatattgtaattttaaacagtggattgaattattttatttcctggtattatttcataatgcatattgtttttcctatatagaattattctttattttacacaataaagattctaatatggccattgcagtgttagctttgttccattattagaattgtatcacacaatttttttatagtaaatatgatttgaaattatttctaagttaattaaatgggccagtaatatattctttaaaataataaattttgtcactgtgttagtccattttcatgctgtggataaagacatatccaagactgggcaatttacaaaagaaagagtttaattggacttacaggtccacgtggctgggggagcctcacaatcatggcagaaagcaaggagaagcaagtcccaccttacatggatggcatcaggcaaagagaatgaggaagacgcaaaagcggaaatccctgataaaaccatcagatctcataagacttattcactaccacgagaacagtatgaggaaactgcccccatgattcaattatctcccaccagatccctcccacaacacgtgggaattatgggagtaaaattcaagatgagatttgggtggagacacagccaaaccctatcagtcaccatctctgttcatttatgtgtatttactttaaatgtctaaaagatagataagtaccctacaagagtttatgagagttcatagatcccatggcaaaagttaatgagggtggatatcacattcatttgaagaatcatactacacattacaaaattgaattatgagattgaaaaccatgaataaatagttcaacaattcagatggaaaggaatgtctcttactaatcatacgctaatggaaccattgttcctcagtgtcctgacctggccttgttcttccttctctctccctgatggtctcagcacctcctttgccccagctgtcagctcaatgctgttgactcctaatctaaattttcaaacaaaaactccttctcaagattcatgcctgcttgttcagtagtatgtcaatatcttcatcttgatgtctcagaagtatctcaaatcccaaaccaaacatagcaagtttccccttaatctaagcttcttcaattctctgttcttagtagtgatagcaaaatattttggttgcaagaagcttcgaataataaaagcgttcctagttgtgcatttctttttgtgtccagctgctgagagtgtgctgctatgtattgtctactccaattctcaacatgtcttttgtgtggtttctctttttccaaacacagtactatcacctttttaattacaactctttcaattgtgtcctaactggtcattcttttttttttttttttcatctttctgcactgtgatataccttacccacctcaaccagattaatgtttctaaaacattgctgcgagcatttacctctgctccaacacctttaggattcagcaggatgtgctaactctccgaggcctggtcctctctgtgcagatgcagaccttcgcttactgggagtatcctttgtgtcagccataggggctcttacatgtgagcaactgcacctgacccacctctgtccccacaccctgtccgagccccattctcactctgatcatcttataatggcaaaactacactcaattgtttctgcttttggaaaccgtttcaggcgctagacccttttgagattcaactcagcttttcttggacattcttttttggctcctcaagacttctcagcctaccctatgcccagaattagataaatgtccacttcctctgctcctaaaacacatactgcatatttctctgatggtattgtgttgatgtctgcatttgtcttctttgtctccctgctgttctcctgcgccaggtgtcatggctgctgttttggaccttctgctgcccctcgcccaggacatttgctgcttcctgtcgtgtgttgccatcatttgtctgtgggttctcccacagaccccaacaccttgctggcagtgaccatcctattattacttgatctcattaacagcagacgcacaagtattacctgaatacatttttaaaaaacatcttagcactcacaaaactaaagagattttttgagttgaaacttgttctgatgacaaaggtccaattgagctatgaactacaacacaatacactatggtacactgtaatatttctcatttctaatttgaaatattggactcatgtcattatagaaagcgggagcaatttttttttttttggagacagattcttgtttcccatcttgttgcccaggctggagtgcagtggcatgatctcggctcatggcaacctccgcctcccaggttcaatcaattctcctgcctcagactcccgagtagctggtactacaggtgcccgccattacacctggctaatttttgtatttttggtagagacagggtttcaccatgttagccaggctggtctcaaactcctgacctcagttgatttacccgcctcggcctcccaaagtgctgggattacaggcgtgagccaccacgcccggccagtgggcgcaaatgaatgaaaaaatgtgtttaggaaaaggtgtttaagacccacatgtatagccatttgacatctacgtaagtgggaggagttgcactgaccagattcctttcaagaaaggacatgttaccaccaattcatggggtgatgtcatctggaagttattggccacctcggagattgtctcagctgcagaggcccacttcacccaaggacaggctcttttttggagtgtcctcaatctagtgactgattgaggagcaattctgcccaaactcaggacaaccctgaaggactgttcttgctccagagctcactgtcattggcctgcatcccagctcactctttcttcgcccagtccttcttcctgtccttccctcctcggttgttgatcataaggcactccttgataaacactcttcacactagcatccatctcagagtcagcttcccgaaaaacccaaccacaatggtttgtttcatctacagcaaaaatgcatgcaccattaataacaaaaccaggtctgtgtgtgacacactctccatatacttcaaccatccattcacattactttaactcatctgggactgggactagaagagaattagtgctgagttctctttcaaatatacccctctatacatgatgaaaagtatcttgttattttccctcagaacaaggaaaagatagaagaagaataaaaaaagaagcaagggaaaacgtttaaaaggtgaattttaaaattgttgctcactaacttaaaaaaaatgctgtgtttgttttgttgtttttgctcattcagctggcccaagtttagctagtgttctgagcaaaaattcagtttttctctctaataattggaatatatcaggaataagagtagctaacttttctacaatgattttaaacaaagtagttcttctataggatgcttattttagactgctagactgtgaaaagaggtaaagagtcataaatataacaacgaagtaagggggctgggtgcagtggctcacgcctgtaatcccagcactttgggaggctgaggtgggcggatcatctgaggtcaggagtttgaggccagcctggccaacatagtgaaaccccatctctgctaaaaatacaaaaattagctgggcatggtggctcacccctgtaatcccagttacttgggaggctgaggtagagaattgcttgaacccaggaagcagagattgcagtgagccgatattgtgccattacactccagcctgggcaacaagagtgaaactctgtctcaaaaaaaaaaaaaaaaaaaaaaaaaaaagaaaaaaaaaagagagagagagaaaaggaaataaaaggaaggcaaataacttttttcccaaaaattgtttaaaattatcaagtaagtccatgggaggaaaaaaataattaaaatgttttaggaacaagaaaaagatatcccaaggcataaagtagaattataataaagagaaacacaaaagatgcaagttggatacaataaagggaaaaaataaactacttgaaatttgggggcgtaaaagagtaaaacaaactctgagaagcatggcagtgtctccttccaatgcacttccaaaaaaaatggatgccctgcaatattgtcaaccagatgcctaaaggggaatgtggtggaaagaactggataatttcttggggccatttgagtcttcaatcatatgaaacatctcttgaaagttatttttatggagtgtattgtaaagccataatcatattatgttgaaatagtttctttaaaagattaaaacgaccaagaacttaaaaacttatgataatatctatatgtaaacaattagagtcaccatggtctgagcaggatgacaggttatgtttcccctggttgagagcaataataccttcatacagaagactgtaataaaactgagttacttttctgcatttttaatatgaaaagaaaagccatttgaatcatcaaggcatcaagaaaatgaaacatatctcatgttttacttatttagttagagaaaagtgtcatctagatgaggtacaattattttatttttgtttatatggacttctgatggaagcaaagccatgtgaccccaaccagaggtgacgacaaccaggcttaataacaaaagtaaacaagattcataaaatcactggtattcattttaaaacttggcttatttttccaattagtttttttacaaggattgttagtaatagattatttgcttgagaagtatttttcatgacgttggcttagaaaaggtcatagctctttagaagcttggttaataataactgacttgaagaggcttttttttaagtaaagtgctgaaatatgttacagtgagacaagggtataaaaaggtagtcaatatatttcacagaactaagactgcctctgacagcaccatcatggtatcttggtagatggagaggagaagaaaacatgggtcatttaataaatattgggataactgactcgatatagatagaaaatatattggaccccagctttactatatctgtgaagctcagtgtgggttgaaggcctaaatgcaaacagcaaaaatagagacatagaacaaatacagaaaaaaataggaatgcatcttcatgagctcataaatttcttaaacaaggtccaaatgaagacaaaggcaaagttaagagagaaaagacagccttggaaaagatattcacaatcatttctaagtaataagagattcatatttatactaaagaactacagcaaagcaggaagaagtagcaggagtgatagcaaatgcacaaagcaatgcatagatgaaatcctcagacatctcctgagagtataaaaagacattcaagcacaatagtaatgaaaagaaaacaaattaaaacaaagagctcctttacatcaatcagctttgtcacaaatagaaacacaggtaccaggatgcggggaactgggacctctaatgcatagctggtggtaaagtaaactggtataggaattttggagagtggctatgcaattattagtgaagttaaattctatgacctaacaattctactactggccctctagtaatattaatactacacatggacacatttataagatacccatggtagtatttgtacagagtcaaagggctgggtggggggcaaactaagcattcacttttgtgctgttattgtatatatttacatgcatgtctaaataaggatgccagaaaattaatttaaaataaatatattaagtacacataagtctgtgcctatgagacagggacaaacgataccagaattggtggatggttgaaaaaaggggggacaagttaaaataaaacaaaataaggatcttgcatggacagatgataatggtgtggtgtcagccaaaagttgacaaaacaaaaacaaaattcaccattgggatttttgttcatgagtcccaaaccatggctcaacagtgggacatgggctgcaactaggcgttcttgtcttcaggacagaggtggcactctcattcccctcttttattcattagaaaatgcccagagggctatgtttcattgagacaaaatagacacatcagtgtgtccttcaaaggaaaggagctgctgaacttcgttgcatacaaagtatttaaacaaatggggacgctagagatggttagccaggaagacaaagcttagtcttttgcacgactgggagctttatgtggagaaacggggaactatttagtgttgctctagagggaatattcgaaccagaaagaagagaagagctagagaaggcatatttgtatgtatctctatttgtatgtatgtcagacagaggaagaactgtctgacaatcacagccatgtagaaacagaaagggctgagagcttagtgaaccactgcacagatcgtgcaggaagagtctagaaaaatgtggggtacagtccaggggcatgttgaatatcacatgggaggctggtctagatgaacttcaagctgatttatagccctaagattctaagagtctataattgtatcatgcatctatatatctgtaaccacatatatatgtacttatatataatatacatatataactatatgtatatttatatttgtgttttatatttatatatctttatatttaaaatataatgcatataaatgttatataggtgtatgaagtacacaattttattgaatttatatatttaaacaatttacatgtgttttgagtcaatgcatataaaagatcctaccgcatggttctgaataattgagagttgttatttctgacttaaaatgtcattatcacggcattatttttagcactgccaaagagtttttccctgtggtgtgtgcacaaacgtgtgtgtatttgcagattaattatgaattagacagcaaaagtgttagtaatttgcttggcattcttttccctttcttatctctacataattctctccttctctaagtttcccatgttcagcaagtgcaacaagtattataaaacataatttatcttgcaattttaactaaataaaagaattgtattcttatatgttgattttgtatcctgcaactttactgaattggtttattacttctaatcctttttggtagtgtcttagggttttctatatatatggtcatgtcatttgcaaacaagttaatttcttcctttccaatttgaattatctgaatgccttgtatttctttctcttgcctaattgctttggctgagacttccagtgacatgttgaatggaagtggcaagagtgtgcatctttttttttttgttcagaatcttaaggaaaagcttccaacttgtctcgagtacaatgttagctgtaggtttgtcatgtatggcctttattatgttgaggaacattccttctgtatctaaattgttgagaatatttatcatgaaaggatgttaaattttgtcaagtatttttctacacctattgaaataatcatatgataaagctacaaggcaaaaatcagtagtgtttgtatacactaatagtgaactatctgaaaaaaattaaagaaaacaatctcatttacaatagctacaaaaactaaaatacttatgaataaattaaccaaggaggtgaaagatctctacagtgataagtataaaacattggtgaaagaagttgagaaagacagaaataaatggaaacataacttgtgttcatggatgagaagaattcatgttgttaaaatgcccatcttacctgaagtgacctacagagtcaatgtactttctaccaaaataccaatgacatttttcacagaaatagaaaaaaaaatcctaaaattccaatataaccaaaaaagagccagaatagccaaaacaatcttgaggaaaaagaacaaagctagaggcatcacaccacatgacttcaaaatatactactgagctataataaccaaacagcattgtacttccataaaatcatagaccaatggaccagaatggtaaatccacacatttacagcaaactgatttttaacaaaggagccaagagcacacaatggggtcttttcagtaaatggtgttggggaaactagatacccacaagcagaaaaatggaattagatcattaactttaatttatgatgtctctaatgccatatacacaattaaactcaaactggatttaagacttaaatggaagggcctaaactatgacactactaggagaaaacatagggaaaaatctcctaacattgctctgggcagtgacttttggttattaccccaaaagcatggacaacaaacgcaaaaatagaacaatgggattacatcaaactaaaaaaacttctgcacagcaaaggaatcaatcaccagagtgaatgaagtgacaacctatatatagaaggaaagaatatatttgcaaaccgtacatctgataaaaggttactatccaaaatatataaaggattcaaacaatgcaatagcaagaaaacaacctgatttgaaaataggcaaattgaatgaatattaaaaaatgggcaatgaacctgaataaacatttctcaaaagaagacatacatggctaacaggtatataaaaaatgctcaacatcgctaattatcagggaaatgcaaactaaaaccaaaatgaggttatcatctcacacatgttagaatggctattataaaaaacatgaaaaaaacaagcatcggtgaacatgtggagaaaagagaagctttgtactgtattgataggaatgcaagttattatactcactatagaaaatagtatggaggttcctcaaaacattaaaaatagaaccaccatattttctagcaatcccattactgggtatacatgaaaaggatatgaaatcagtgtgttgaagagatatctacacttccatgttcattgtggcattgtttacaatagccaagatatggattcaagtggctaaatggtcaccagcagatgaatggattaaaaaatatatggtatacatacacaatggttgccaaaaaaagggacaagttaaaataaaacaactgtaatccctgcactttgggaggccgaggcaggcagatcacgaggtcaagagattgagaccatcctggtcaatatggcgaaggcttgtctccactaaaaatacaaaaattagctgggcatagtggtgcacgcctgtagtcccagctacttgggaggctgaggcaggagaatcacttgaacccaggaggcagaggatgcagtgagccgagatcgcgccactgcactccagcctggccacagagtgagactccgtctctaaataaataaataaataaataaataaataaataaataaataaataataaaaataaaaaataaaataaggaccttcagccttaagactattcaaccttaagaaagagtgagctgtagtcctttgtgacaatatggatgaacctggagaacattatattaagtgaaataagccaggcacataaaggcaaataccacatcatctaactcatatatgcaatctaaaaaggttgatcttatagaagtagaaaggagaatggtggttcccaagggctggagttactggggaggtgtgtgtcaaaggacacaaaatttcaggaggaaaagtccaagagatctattgtacaacatggtgactgtagctaataatttattgtattcttgaaaaatgtttacagtgaatgtaaagtgttcttaccacaaacatgataactatgtgagacaacctatatgttatttgatcagatttagtcattccacaatggatatatatttcaaaacattatactatacacaggaaatacgtatcactttatttaaaatgtaaatacatattattttatttacaatgtaaaaaatcatgtatatacatttaaaatcaatatgtaatgtaatatatgcaatacataacatatatttatgcatatatttatatatatcaaaatatatttattatattatatgcatatatttatatataataaattatatatttattatattatatgcatatatttatatataataaattatgcatatatttatatatgtattatataataaatatatattatacatatatatatatatagcattctttcataatgaaaccaatcttacacatagtctttttttccctccaattagggtaaagtaatttgagatatcgcttataaaacacttaataaaatgccatattttaaagaaaggtgtctgcttcgatttctagaatagaggaattttaagtcattccacctccaggacaaacctgtctgaaggaacccatagaagctgagtcctgcactcaattttgatatcctacctctcttctgcagacacttgagagcataaacccccagggtagctgagccaatgcatccatttaagtatattgaagcatgagtgctttcttgcgtcatttaaaaagggaggacagtgaaagttcccacttcattagctttcttttctcacattagggtattaaattaaaaagagagtataaattctcattttaaataataaattaacataaaaggattatacatttaatacgttaccattctatttttccccaggtctatatttctcgtgtattattcataatagaagctctgcaattcccaagtcgttgttgaaaaataaatatgaaaatatgtggatgactgcagtgtatggccacacacaaaagaccccagcaaactggagcttaagttaaccattgctccactttaatgaggaactaaaatggaaaaataaactcaaaatgctgtcctttccataaacaatattgcaagtaactccagtatctagagagatagtaggagaaagtggaagaaagtgacagattaagaatgaaagacctttccttgccaacagagttgggtttggaattcagtggaagctgatagtgccaaggttggaacagctaatgagcaaatgtctgaaagcaggagtggggaaactgccaaggctgtttctgtgcacaaagctgtccctccacctaggcgagatgacatttgttcccagcctttgaagaatgatgtcattagaagacggcatccccggccgctcacctcgagtggaaggcgagcagacacactcacagcattatttttaactcagcattcatttccccacttgcaccaacagcaatacagcaagacattacggtgacagacgagacacagcacaggacaaaaagctgcagggaagcaggattttaacgtcaaaatgtgcagaacagtgtccctgttgggctacagtacacaaagtaccaccaacacaagagctgaaaaccctggcagtgacatctaattctcccttcaatttgaaggaggacatggtaaaaaaatgctggtacattaaaatgagaaatcgccacaaatatagaaatggaatgaaatatgtaaaagcgaatgtttctgttgttctctgcattcctagcatggccatttcatctcactattggcaaacattcacttttaaaaatcctcataaaatatgactctgaaagcttggtgcttcttagacatttatttacctgtgattttaactacccttctctatgaattttagtttgctttcctgtctatttttttaaatccccatggtctgaagccagaatggtgatccacaggcacttaagaccaaccccgccatccaaaggctttcgccaagacactcaggtgccacatcgctcctctcagcctctccatctcccaagcaagagcttctggagtcctttcttgttctgacctgccctctttcaccaaatccattctctccttttcctctctccaatttaacaaatgctatctctcttaaattagtccctcaatatcttttgccctacattttaacatgttgtctgtcttgactttttaaatagctttattcctgggttctttgtattcatttctccccactcctaccctggcttcccgctgcaatacgaattattcttctgagagtcaccacgggttgtgttggaatcaaaacatctgcgtttgagtcttgaatgtattactgggtgactgtgcgcagcctcatctctcttctattctttccctgattatgctttatctacgttacagagtcactgtattaattaaggtgacacagatgaaagtgttttgtaaactataaagttttatataaatataaataaaaggtgacatttttatccagcagccaattaactttcctggcagtgttgatccccagcaattagaacacgcaattaagcaccgttcaagttcaatgtggcacctaaaatgggaaagacaaagcttgaaaatgtgttaaatataaaactgcttgttaagttgaaatgaagtgaaagaagggactttgacttttacttctgcctatatgtttgaaggcagcaaacttgcacttctggatagttacatatatttcagaactgcttaagcttcaaccaccatcaataataagcatattatttatatcaatctttgaaataaaaaaaattgcaggcatatgctccaaaataagcaaagggttatgactattgccaggaaaagacatgatgaaaaaatagtattgtttccaaatatcatctaaacacatatgcacacactttccgctatatccagtatttaaaacgaacctcctggggacaagataacaataatttggtttccctgttagcagcattattgccgggatcaagtgggccacttccacttcccaaggaagccaatttttaaggcttcaggtttgctcttccaaaattagctggctgaaatattcactgtgtggtctcccaggaaaagtagtggagctgcatttacatgaacaaaataagaaagtctctttcaatcctaatccacagggaaagccaaaattctaagtcttttcctaaaatttagctaatttcttatctccctcccctaatacttggtaactgaaaatagtaaaggttaatttttaaaaagccttgataaactacaatcctgaccattggagtataatttactttatatattaatatttcatttaaaaacattttactgatcgatcgattgattgattgagacagagtcttccctgtcacccaggatggagtgcagtggtgctatcttggctcactgcaaactccgcctcctgggttcaagccatcctccctcctcagccacctgagtatctaggattacaggtgtgtgccaccatgcctggctaatttttgtatttttagtagagaccaggttttgccacgttggccaggctgatctcaaactcctggcctcaagtgatcctcctgcctcggtctcccaaagtgctgaggttaaaatattttaaaatgtaaacttaaatgttcagaagtcattttatttaagacccttctaagttctgagtaaaggctaagattgcgaatggtgtaaaactgttactgtgttttggaagtagttcaccacagtcttgcactcctggcctcaagccattcttctgcctgagtctccggagtagctggagctacaggtgcgtaccacatcacacctaggcctcccaagtagctgggattacagcagtgagcctctgcacctggctgcttaagcaaaggtaatttgggttctcgcaccttgcaaccaatggggtcatagtcaatacatggatctgtgccaatctgggaaatctaaaaataggtaaacttacatttcaaacagtccttgtttgaatttttgtcagactttattttcagatatttggtgaagggttctaatgtgagcctgactgggggctggggaagcctgtacatatgaagttaaaatctgcggtgtagtgcacaaagtcccctgagggtcctgttcaggccttggtgttgaacatcatctattcactgatgtcaccagatctgcagcctggattcctgaactctactctcccatatctaatttcctactgacagcatccacttctttgtttagtgtgtatttcaacctcaacacatcgataactagactcctaatcgccttcctcaaacggctccactgcatcttctgctgactcagtagaaagcaatgccattcttcctgatattcaggccagaagcctgacctgatccttgatgtctttattttcctcacacctgtatccaaccactaggaaaaccgactgaatagaccttcgaaatagatccggagtctgtcttctacccccaacctcctctgctctccccctggtccaagccaccatcatctctcacctggattcactttccaacaggtcattctacttgccccctttccccgaatagaccattctcagcacaggaatcagatgcgtccttcttctttttagagatggggtctcactatgttgcccaggctggagtgcagtgtctattcacaggtgcaaatatagtgcaccacaaccacaacctcaaactactagactggaagtattctcctgtctcagcctctggagtatctgggactacgggctcgtcccaccttgcctggctaaaagcatccttttaaaaccttagtctggccatgtgacttttctgtttaaagtcatccaataaagcccccatctcactcagcagaaaaccccacgtcctgaaaaccgaagtcctgatctagtaagtcccccgtgaaaaggttctgctccttctgactcagggccttttagtgttttcttgttcacttggctcccaccacaccagcctctctgttattcctcaagcttgccaggcaaactctagacaccgtggttgtatctcttccctttacctaggatgtcccttccccaggtatccatgagctgtcttgaaccccttcacatctttgctcaaaatctcactttttccaggcagcttttcccgactattctgaaaaatttggcaagccccaaatcccaacaactgccatttctctccaggcaataaaataccacataaaataatattttccttcttttgtttgcaagtacttgcaaaggagctgacaagttttatactatatgataagtattcagaagaaaagaagctcctgaagaaaaaattattcaatagaattatttcctaaaatcataaatatattgtttataagagacaataaattattcttttggccataagctagtttgagttggtttctgtcacttcaaaaggattaagatgaatacattcatttatactgatctggcaaatttaaagaataaatgttaatgattcaaagggctttcgtttaaatctatgtctcctaaaaattacattaaagtattatacctatttatccaatggtcatacttctggaaatttttctcgaaagaaataatcttaaaatcagacaaaggccaatgcataaagaagttcatttgatgcctcatttgtaatggtcaaacattaaaaataaactaaaattttagcactgtattagatgttttcaaaatgtagctcacagacctgtagggatccctgagacaattttaggtgatctgtaagaagaaaatcgttttcatgacaatgctgaggtgctgtttgcctttctcatggtgttgacatttgcactgttggagcaaaagccatggtgggtgagactgctgggcgttaccatgaatcccagcagggacactaacaggatgactattcattgtactgtttaccgatgcatactgtgagttggttttttaaaaatgccagattcacttacagacacttgacgaagcaggaaacataacagttttattacatctttaccctaaagctcacgttatttttaatgttctatgtcctgtgtaataaaatgggaagaaggcacagtgtttcctccacctcctgagcagcacggctattttcaagcagagtatgtctgtgcttgcttgagttgcaaattcgaccagctgcttttcttcatggaattccatttctttcttaaaagaatggctacctaaaaacgatggttatgcggtcttttctatttgtcaaacaatttcttacagataaatgagcccatcactcctacaattacaattgatggtgtttattataaataataaaattgaatctttcaagaaagaatagaattttagaaaacttgcatccatcagcatgaacttgacagtttacttgaagactttctgatgagatcatggtaatgttagtagttgtgatattttgatattgtataacaaattgtatcaacatttggaagatctgtgtaacacagtgaaccaatcatttccaaatgatcaactttttatgttacaaaatcatgtgtgggtaaaacattccttccaagggtatgatagaccaatgaattttaagatgacagagtacagaaaatgtgttgatatggcatctgactattgcaatgaaccattaagatactgccatgttttaattctctgcatagtatggagtaccattaggtgttttctggtttattcacttgttttatttgtttattgtttgtctctcctgactgagaagagagtcaatgaaggaaaggaccttgcagacctttttcattgttgtattcctcagtgtctagagtagtgcctggcatgaagcagatgttctgtaaatgaggattaaataaataaacacaaccaccaaatgaacctttatgcagcctggtttaccaagaatatctagtgatttgaggaaattctcaagacatatggttattaaaaaccgatttataattatgtgcaggcatatctaatatacaatgcacaatacatattctataatatataatgtaatgcaatatatatgccccgtaataatagtatacacatattattatttccatgtgtgtgtgtctgtatgcgttctcacaaaagtaaaactcacagggttggtgggaaaagaagcttggggaagaccacaggaaacctatgcaactttgtaacaagggcaactaaaagccacttattggttcctggagagagaacttggacacctcagacaggcagctcaatgtggctagaagcaacacccacaggtttcggaaatagttttataacatattagttctattcctaggacccacctcaggtagattccttacataattaaaacaattttatttcatattcagctcaggaaactgacttgtagaatagaagaaatgagtctttctgaggctctgccactaaaagtctgcgtatccttggatgagtctgatcaccttattgtttttttctggtaaggagattgtagtcaattcaaattgcaggatctctaaagatcatcctgacaggtagattccatgacagtccatgtcatgatgcaaagaataatttaatgaggaaaacgttctgtggcatcctttaaacatataatttctatgttgttgctttgacctgctcatctacagaagataagacgtttgtttgaaatcctcatccaatacagaaaatcccttccagtgaagttctaagagaccttgcttttaggaggttttaggaaaagaaggttatttatttaaaaattatctgagagatgactagataatgaagctaatgatgtgctccttttttttctgttgtattgttaacaacacatgccctctggaaaaccaagccaaaattccacctggagagaaaatcagatcaactaaagttcctgtgaagattcagtcagtagtaaagaggacatctcatgttccctgtcattcttcagcctgtacaattatcctgctctaaataagcagatcttggattacccgacttcaaatcattggtctgggaagtagtcgggctatggaatgagttgtgtgggaaccaggagaacagggcttacctttcacggtcacgtggacgctctggctggtggagagttgtggttgaaccaacacgttgcacgtgtactccccctcgtccacttccttttgcacatctgaaagtttaagagttccattgttctcaaatgccacttggcggtggttgaaaggaagcaggttagagttcttgtaccatttaatggagtaatacggatagccaatcacacgacagtgaatgtatgtgtcccgtcctgctattgctgtgatgtttttcattggtcgaatgcttgcaggccctggagagacacaaagaaactcttgaaaataatttaagggtacatctcatgtagggaaatgggtacacttttccttgagttaaaaatgtagattatattcatgtaagcacatctttttcagttaaacaaatatttttgcatgtggcattttctacaacaaaggtttttctttccttttcttaaattcaaatgtataactgtgaaacactttatctgctacttctatgaaaatgttttgaattaaaaattacaagataaaaggcaatttaattaatagaaagtaactagtctatactggacaatcacgcacttttggtgaacacactggcagcaattgatcaattgtttaactctctctgtaaaatctaggacgacaatggaggttacatcacgttgcagcatgaatgtaagtttaataccatgtacatgaaggtttaccatgaatgtggaagaaccgaagagaaggagaagggaaagggcatgcagagcataaaccaggaaaggaaacatcaggtgaacagatctagagtaaaaaagaacaagctgactacagaaaccaaaatgccatttccaacattaacccagtcagtgccattcctgagtaggaaggagagggtaggaaatgggaagcaacagttaatccgctctggcattccaagacccagctcggtgcatgcagaaatcttcttctccactataatgagttatgtgtgtttttttgaggagctgatttgacaagcacctcttacgtttattcgagcctggtacaggacgactcccgccgagttgttggcagtgcagcggtagactcccccgtcccggacctgggagctggagatgttcaggtagctgaccacgttcccctccgacgtgatcatctggctgatgcggtgactgccacccttgagaatcgggtcatcgtccagggtccacgtgatcgtgggcaaaggtgttcccttcacgttgcacataagggaaaccggctctgctggactcaccaccttttcactaaaggcagaaataattttgggagttccatctgcaggaaaacaaattatggaagaaagtggcacatacaaataattaaacaacttccaagtatatgtctttcatgtctagggggtaaatgtcgtagttgttaaacattaccaaaaaggtctggttttcctgataaagcaaaacgttaatcagaacaagagttcactgttttcaaaacaggtaagcacagtgttagcaagctttcatcaactgtttctatatttcctgattgacttaagaggaatggtaatacaactcagatgttcaggttaaacaatgacagctcctaagaagtccttaatttaaaactggtgtttcctcacacaaagttataaacagacggaaaatccacacccgctcactcccacaaacagtcactttatctgttaggttggtgcaaaagtgattgcaaaaagtaatggcaaaaacagcaattacttttgcaccaacctaatacttcctcaagttatttggggttttctcactagggaattctttacaggaataaaggaaactactgagagattgatgacctcatcttcatcattttctcataagaaatcctcttttaataactttaattacaaatagtaattgcatgcaaacttccatgaagtctctgagaatgggtagaagctaaataaagtttgtattaaatgccgtgtattaaaaacctctaaagatatcttaagtagggtacttaagcatgttttaaatctctctaaaagtatcttaagtaggctggccatataatttaacatccaacctgggacacttttgaggctgaaacagaaaggactaataattatgccaagagaacaggcatgacccagaactatcgcaggcaaactaggatcttaatcttagagaagtctccatagaaattttcagtatgtttacatagatcaaattttcatattccattatttttctatcatccatatggttttttctcttatatagtaatagttacaaatgcatgtttcttttatatatgtttttccatttataaaaagaaatacatgcatattaaaggaaatgtatgaaaatcagaagaaaagttaccaataggtcagccagcctcaggcatacaaatcaacactgtgacacattttttctaggcataagtgggtcattttgacataattgcaatcacatgccacaggatttctgagtctggtaagagaccttgctggaggggacatcttttgttttttaaaagaatttttgtgttcaattaaagggttgtcccataatgaaagataagaatgagtagattttttttagtttttgattttattataaaagtaatgaatctccattgttgaatatcttttttgttgaaaattggaaagtattataaacaaaaagaaaggaggcaagcaaaattaggatagcttgcaattccatcagggaaaggtgacagttaatggttaatagtaccagacacctttgaggaaagtgccactcattcccccagaaccttggggcctagttcttggtcagggaggccagttatgtagggtcttcatggtgatggggctgtgctgcagctcttccctccaccccctactcctttccaaattcctgaatctcacttcttcattccagctcatgtttcaggtggctggagaagtccctggagtttgtttcctccaggctatgctcataagtagcatattgcagtgtccttgggttgtaagcattttgtctcttactatcagagatgaaaaagacaactttaaaatattaaaatgaaaaattgatgcttttgtctttaacgcactgcagacgttgcctcatcacatcctgtgtttaattttacagagaagttagatgtcatcatgattgctattcattgtccatgatcagtcattaatacttaggagtactggagttatttcacgtgtcctttataattccatggtttttgtaaaatgtgtttagctgtagatttcttttcactggtttttacattaagctctgaaaactcaagtgtttagaaaaatgttcttcagttatacttctctttttgtaggtaaattttacatacagtgaaatatacagatcttaagtgtacagcttagttttgctaaatatatacacaccagagtaaccacaaaaacgatcaagatataaaacatttccattaccaaaattccttaagtgctcctttcaataaatccacatccaacagagatcactgctctgattcctcttaggatgtgctggttttgcctgtgcttgagcttagaagaaacataataatagagtatgcacgctttatatgtgcatatatatcatcataatcagagtacacttagaatataattagaagatgtaactttggaacagtactattatctaactcactgtccacagcaaaattctgtccattgaccgctaatatccctcgtcactgttttttttccagagcagtccgtatcacccattatttatgtttcatgtcatttcagcctcttttcatctggaacattcttcagcctcttttgtgtttcttgacttttacatttttgaagagtaattttgtagtcagttgctgaaattgggtttgtctcatatttcctcatgactaaacgcaggttgtatatttttcccagaaataccgtggaaggcacgtgttttatgtgcctattggccatccgtgtgtttcctttagtgggtgtctgctcaaatctttggccattgttatattagactgtttgcctttttgtttttgatttgttgtggaatacaacaattgaaatacaaggaaatatatatatagtatctatgtcagatatcttataatgatctgatacatttgtaagattcctatagagattatatataatatctgtcaacatatatatgacacatatatttgtgtgtgtataaaatattttatcccagtctgtggttgcctttttcttttcttaataatgtatttgtgttgacatttaatgctttctgtgtcctaagaaatcgtcacctattcgcaaatcatgaagaattattctgttttcttttggagactgtgttgctttatactttatattcaattctatacggatagcaacttaattttgtgtggatatgaagtgtgatgtagggattaatactcatttttttgccatacatttattgagttgtttcagtgttaatttgttgaaaaggtacatatagtatgtgtatatgtgtgtgtgtgtgtgtatatatatatatatatatatattttttttttttttttgagacagtgtctctctccctctgttgtccttggtgtggcacaatctcccaagtagctgggactgcaggtgcacaccacgccttttttttttttttttttttttgtagagacaaagttttgccatgtttcccaggctggcctcaaactcctgggctaagggcctcagcctcccaaagggctaggattacaggcacaagccaccatgcctcagttttgcttgaaatcacattaatcgttttagagagaattgttaacttaggaatatttagttttctaatccttgaatatggtatatcttttcaattttttaggttatttcaattttatattagcagagttttgtatttttgtatgttgaaatctttcacgtttgtttaaaatatattcctatcttatgttttatgttattgtaaatgaaagtttcaaaatattagtttccaattgtttgttctgagtatatagaaataaaattgcattttgtgtatcattcttatatccaatgactttttaaactctcttttagaaattgctttattgttttcttggcatattctttgtaaacaacaatgcctgtaattaagacagctgaaatttttcctttccaaactccatccattttatttctactcaagcctaactagggctgctagtataatgttgaatggaagtggtggatgtgggcatccttgatttggtctcaatcttaaatgaaaaacatttagtgtttaaccaggaagtatgattttagctgtagattgttcaggatgccactcattaggtcaaggaagctctctagagtctcagtttgctagaaattctttatgctgaatggatgcaagtttcatcaaatgattttttctgtatatattgagataatcaattggatttgctcccttattctattaacatagtgacttacacggattagatttttaatgttcttccaatcttgcattataagataagctccaattgatttacacacacacacacacaatctatatgtatatcaatgtgtgtgtatatgttttaaattatctctgctaaaagttaagattgcagtactttatgtgaaatgtaagaaccctgcaacaaataattctgccctttgtgttattacatctattatatttactctataataaagtgttattttattttactttattttatttattattattttatttcattttattttattttttattttattattttatttcattttatttattttattttattttatttttagagatggagtctcactctgtcacccaggctggagtgcagtagcaggatctcggctcactgcaacctccacctcctgggttcaagctgttctcctgcctctgcctgtagctgggattacaggcacatgccaccacacctggctagtttttgtatttttagcagagacaggattttgccatgttggccaggctggtctcaaactcctgacctcgagtgagccgcctgtctcggcttcctaaaatgctgggattacaggcgtgagcgacagcacatggccaagtgtggtaattttataatgttataatcatcaattgtttaaagaaattaaaaaagaaaacacaattttgctaaatatttactaatatatttaccatttctcatggtatttgttcttatagatatgtctccattttatgttccatttctgttccatgttatctatatcctgtagatataaatgtccattctctatatccggcatgacttcatttatcatttattaatgtgcagggctgctgacattatattctttcacctctttattactgaaaatatctttatttttccttaatttttaaagcctgttgttgttgggttttttgctacagaagtctgcgttggcagggctgtgtctttgtttttcgttttcttttcaacattttaaagatgttgctccattgtctcctgtcctccaaaatatccgatgaatcatctaccatttgttattgatgtcctcattatgtaatatttttcctccctcagatttttaagtttttctctttatcttcggttttcagcagcttaactctgatgtactgacatagaattttctttgtgtttatttttggagtttgctgagtttcttagatctgcaaccttacttttataccaaagtcgataaaactaaggtcattatctctgaatacttttttcttctgcattccgtatctcctatttttctgggcctctagtcatatgtgtgtgtcacgttatctgatgatgtcctacttgtcactgaagctctaatcattttctttgcagtcttctttctctccatgcttcagattgaataattttctaagatttatcttcaagttcactgatactttcttcttccttctctaatcttgtattaaacaaatatggtgattttttttcatttctacagactgttttctacagtttcaatttctctgttggtctttcccatacgttcactctttcagtccatattttcctgtaagttattgaacatattttaaatagcatctgtaaagtccttgtttgccagttctaacatctgggtcctctcatgatttgtttctatcgtttgctttgtcttttgtcctttgggtgcagagtcctgttttttgtatgtctcatttttattgcacatttgtattctcactccccatttttggagttcagatgtgtcctcagtggaagaggacactccccaacttgattttggtgtctctcaaatgtctatatatacttttgcttttcccaaagtttcttgtttttatcatcttgggagttaggctgatatatgctattttaccattcccagaactggaaacttttattattcttttttaaaatcattccatttttcaggtattatggttttatcctgaacttataattattaaattccattttatagcctcataggaaatattctcagattctccattgtatctatcctcagtcctagttcacagtattgcaaatttttataattttactttaatccatcgctatttcagtgagaataatgggagtgtttttgttttccagaggaaattagccagacactcttttaaagcaggtactagatatgtatttgtaattccatttctgctttctttgctacattagcactgtcatctctcagaagagagaaaaaaaaaagtgaagcttcttgtcctgaatggaagctgacatgcgacaaataaatctgcgagtgtgctggcggtgcgcctcggccccctttttagttcaagtgacaggctcttttggagatgaaagcagacattattttcccagggagacctgagtgtctttgaaatctttcttgctgtcactctgataacctgaactcttctgacatcgttatggatcatcaatatggtctttaggttttcttagttgcaccaaatggttgccggggtaactgggcctagacaggtaatttctcctttttctacaaagaatctaaaaatagtgactatgtaaggactagagtgcatcatcattagcaaactggttctgcacaaattgattactttctgcacttaattattatacggaacacagtgtcaggcatttaatatgaataccatgccttcagctaatttcacctctgctttaaaaatctcactgtctgcaatgaaacgattgaatcaaaataggaatctcattgctaaacctgctacttcttaaaaaattagctaaggttaaaaaagaatgacagaaatatggtcttataatcaagatatatttaaacttactttcacatattagtgtgttttctttgtactccctttaggctatatcaaaatcattttattattttaatcaattgatatcagatgaattttaaattatatatggacataatttccaacaagacacacaaatacatagatagaagctagttcaatcaggtagtgataaatatatgttgcctgtgatagcttctttctctggctgactgataagctttaagatttagtatgcagtaaccagttaaaaaaaagcaaatcgtatcacatatccaaaacctgttattataccacaaaataattcctcacaaatttcatttacttaaatctgagaacatttggatggaactagggacaactgcaccaaacagatgccatattttcattctaccaaccactgtactgacattttgctctgcattttcaatctgaagttgtacttctccactggaggctattgcccccaccccacccagcaaacacctggcaatgtctggagacatttttggttgtaacaacttggaggaaggtgctcctagcatacatctagtggaaaggggccagagatgctgccaaagatcctataacacataaaaaagtttcccaagatgcctgtaatcccagcactttggggggccgaggcgggcagatcacctggtcagaaattggagaccagcctgaccaacatggagaaaccccatctctactaaaaatacaaaattagccaggtgtggtggtgcatgcctgtaatcccagctactcgggaggctgaggcaggagaattgcttgaacccgggaggcagaggttgtgatgagctgagactgtgccactgcactccagcctgggcagcaagtgtgaaactccatctcaaaaaaaaaaaaaaaaaaattccccaagcaaggcattcttgaaagaccctggtctagagatgaataatcaacaaaactgttaagtgtcaagtttcttctaagatttaaaccctggcagataacttctaatgcacaagtgggcaacatttatgttactttacattacttctaatatgaaacaattttattttcgtcagaactttctctcccatttgcctgatttagcttgaaaaattagggtagagtactagctggtgagacagagagcctagaactgagcgatcagcactgcttcaccctgtcttcttcttttctgagtgctctgggtttgggttctttttcagccataccctgaaacgaggcccactgaccttcaaggaccacctgcacatagtcttgagcggacagcttgtccttgcgcacaaagcactggtatgcgcccccgtcacttttgaccatgtgatccattataaggttttcgtggttgatccctgtgatcctcacattttttccagggttgaggatttcaccattgcggtaccaggagagttcctggtcctcagttcctgtcacgctgcaggacaaggaaacttggctacccacgctgcttttaaccttcctgggactgatggtggctttcagtggctctggaggttttagtaagagagagagaaaaaagataaaaacatcactagatagcatttcgacaacaggctggactttcaacaaagcaagtgcatcacgcaatcatactccacacagttcccatcagccacattattgcaatcatactccacacagttcccatcagccacattattgcaatcatactccacacagttcccatcagccacattattgcaatcatactccacacagttcctatcagccacattattgcaatcgtaccccacacagttcctatcagccacattattgcaatcataccccatacggttcctatcagccacattattgcaatcataccccagagagttcctatcagccacattattgcaatcataccccatacattttgtatcagccacattattgcaatcataccccagagagttcctattagccacattattgcaatcataccctagagagttcctatcagccacattattgcaatcataccccatacggttcctatcagccacattattgcaatcatacccacacagttcctatcagccacattattgcagtcatatcccataaagttcctatcagccacattattgcaatcatactcctaacagttcttatcagccacattattgcaatcaaactccacacagctcctatcaaccacattattgcaatcatactccacacagttcctatcagccacatttttgctatcatactgcatgcagttcgtatcagccacattatttcacagaggagcattttgtttgggaacatcctcttcgctattttttatttctggctttatttctctttgcaacaaatgcaataatgttggtcaaactgccttctcaggagtctctgtgaggatgttgatataaatccactgacaataagagatacaggccaggcatggtggctcacacctgtaatcccagcactttgtgaggccaaagtgggaggatcacgaggtcaggagatggagaccatcctggctaacacagtgaaaccccatctctactaaaaatacaattagccgggcgtggtggcgggctcctgtagtcccatgtacttgggaggctgagggaggagaatggtgtgaacctgggaagaggagcttgcagtgagctgagatggcgccactgcactctagcttgggggacagagtgagactccatctcaaaaaaaaaaaaaaaaaaagaaatgcaacatgctggctaccaatagtgacctaagtattgatcatataaatcctaatttgccttgtcccaaggtggcactggtgggtttgccctgggccattctcacacacatgtatgacatatgtggtttacccagggccaataacacacaattgtgaggaaaaaaaaaacaaaaacaggttggtattagaatttgtgaccacgaaacagagtttttctttaaaatggggctgagtgatttagacagggaagaaactctcatcctcgccttgctatgttttcaattcaacaaccttaatccaatgtagaaaacatttactgagcatctgtcatatgccaaggatgaggttaaactcacaggcaagaaaaatggaataatatttgtggtgcagctagcttgtgctataaaattatcgactatctttcatacatcatttaagtcagtcttctcctaatcctgtaatttttgtgttatctctattttacaaaacagaaaatagttattgagagcgcttaaataactcagccaaatccaatcaacaggtaaatggcaaatcaaaacaaaacaaaacaaaatttttggtgaaagacctacagttacagatttttaaaggtcagaaagtgctgagcagagaaaatctgatgaaaatcctgtctagtcatattacaaattatggaaaacgaaaaataaagagaaattctttaaagcagacagcaaaaatggcaaatgacatacagagaaacaaagatctgaatgacctctgattgtttagcagaagcaaatggaggccagaagacatataaatatatcttttaaattaacaaacatctcttgtagatggcagatggctaagatttgctttttaatccattctggtaatcttctcctattattattattattatttatttcactttaagttctgggatacatgcgctgaacctacaggtttgtttacaccttatacgaaaattaactcaagatggattaaagacttaaatgtaaaacctaaaaccatagaaacgctagaagaaaacctagtcaataccattcaggacatatgcatggacaaagacttcatgactaaaacaccaaaagcaattgcaacaaaagccaaaattgacaaatgggatctaattaaactaataagcttctacttactcagcaaaagaaactatcagaatgaacaggcaacctacagaatgggagaaaatttttgcaatctatccatctgactaaggtctaatatccagagtctacaaggaacttaaacaaatttacaaggaaaaaaacaaacaaccccatcaaaaagtgggtgaaaaaaaagcttttttttaccccagttgttcctaacttttcatctcaccacactttgttttcaaggagctcagtcttctaggttgataagacaaaggcaataaatggctgtaataaccaaccagagtgatggaggggccattagagacatagcacatgtggaggagggtggatgggaagagcaggaaatccacagatatcaagggtgcatagaactgagatcagtcagaatggaaagagggaatcacagagattgggaaccacatgaattaaggcagggagcaggggcatgtctgagaatttctgattcattttggatgcaacagagagtccctgagattttggaattaaacaaagataactaaagaaggcattcaaaagtgtttagcaaataagtcatacttttttttttttttttttttttttttttagaattggggccttgctctgtcacctaggctggagtgcagtggcacaatcatacagaggagtttctgtagcctgaaactcctctccctttctgcctcagcctcctgggtagctgggactacagacacaagccatcacacccagcacaaacatacttttaatggaatcactaggtcataggtcttttgacaaattagggtgaggaaaacccgtcattgaagacattacacatgtctagtgtaggtacaattaagatccaatctaggacaggacagaggttgagaacagagctgagtaactgtgagattcagtttgtatgacttggcaggacatggcaggacttggcaggatgtagaaaggaaaggcttaaagggcacccaacatttcatgtttgcatctgagggatgagaaggaggaagatgttgataataataacaagagccatttggaaggaagaggtggtggagagttcagtttggtatccgaccctgttgttttgaagtgccaactaaatttctgaaagaaagctggttgacacacttgtctgacattcaggaaggacgccaaggctgtaagtacagattcagagcttattttcaggggcaaggaattcgaagctctacaaatgaaacagagcctaaggaaaagggaagagcttgacaagaagacagttctgaatttggagcccaagagaatgccttccaatagagaagagagataggaacgaagaagctgttttcttctgcagttagaagaagcagtcagaagggaggcagagaatattccagaagcattggagaatcacctagatgtggaagaagggaacaatgataaaaataagcacattaagaataaaggcttttaaaatataggtagtgataaacgcctttagagagaaagcagtaacatactctgagttgagaaggagacaggagaatggggaacaacacatctttgtggatggaggctaagagagttgggaagtgttagataaccaagtattgggaaataatcttccatgtggaggaagcaacataagtaatgtgacttgcaatcaggaaaggaataggtttgtgcagggattaggaagaagttagatttagcaggaataggtttttattaacccatttatgcctgaggttgcaattttttttgaatttttgcaatcagaccttggtgatgaccttgcacagtaggatgtaaataactcccacatgcttagtgttccaataatggaacactagtcataagtgggttttaatgcaaaacaatgggaaatacaaccagacagatttgcttgagatgccttcagtactatcctaagatataaactttattcaatggagaacagggagctaggagaggtctttaaacacagaagagactttgagcccgtgggaataattcttactggctgtccaatgctgcattattttatccacatgattcttcagctatagaagtgtgactgtggattttatcatccatttctttctaatcccagactaaacatattcaaatatttgcaggattcaggctggacagcctgttccagatagagagtcatttggatatttaatataaatatattctcttaggctggtgttgcgctaaggcagtctacactcaggttgacactgaagagaaagttccataaacagggttagggctgggtggggaggaggaagtaagaaaacacttctattgtcactgtgagattcttgtggttaaatttgttcaatttagttcatcaaataaaaatatattttcaaaaaaggagcattatattggcaactaagacctcctctctgaccaatgctctgcctcccttttctggccatgtgatcttgggtaattcactttaatttggtttctgcaagagcaaaattgagggtggttgagtagattagattgtgaccctgcgatcacatccctccttcctccaaatctgccttcagtatccttctgaacacattcctcaaggcagccaaggcaatcaatagaagatcaaataaatccattatatttggagtagatgatctataatactaggcacaagtctaatatttgggtatgtttgagccccgtactttgggtgataatagcctcatttagaaatttaatggagaaatggtctggaaacagacaaaggacaactgctttgattggctaccatcacttgtgctgaaagaacaatcctaccctctctctctgttcatttttagagagactggttgttgtgaattcatcagctaggaagtgttatcttgaaatcatatcttggaaatgtaatagtctgtggcctaatggaaatcacagaggtttggggatcagaaagatttcaaatcaaatccgacagccaagactctccagttgtgtaaccttggggaattcatctgagcattaattttcacatctgtaaaatgaggtttctgttgatctcagctggactgttttgggagttaatggaaagctacagagaaaacatggagatttgcttataacaggagctccatcgatggaagccaacaccacctttgcaagttaccgtccaacttacgtttcacgtacaggcggcctatcaccttagcagttccgtatctgttggacacttcacaaacatagctgcctgagtccgaggggcgaatgttctcaatgagcagccccgtcacggtcttctggaacctccctgaaagttccaggggcatgttgtccttcagccagcggtaatctggctcagggtgcccgagcgctttgcaaggcagctccacacgctgcccagccatggctttgcgatggtcaaacccatccagtatggatggggctgagttcgctgggtctgtagaagaaataaaaactcttagaggcaggaatgaggagttgaagtggtcatttagaattgtaggacttcatgtataacttaaatacggtgcatcataccaactattgatacagatctttaagattttataagtgaacagaaaaagaagtgccctattcatacaatttattttctgctcagaatttacaaaaggttgaacactggtcagagcttctgttggtcattcctcagtaaatgaataaaagatccagaatgagcaggcttcaacaagagctgtcagctcaggccaaaaatcagattgtcttttcataactgggaatgtcagaattctctttaaaagatccttaatgggtacaaatatgcaatttgagataagaaataagacctagtggtagacagatcagtggaatgactatggtttgcaattatgtattgtatatttcaaaatagctaaaacagaagaattgaaataattatagcttaaagaaaagccaaacatataatgtgatggatatcccaagtacactgatttgattttaacaaattatatgaatacattaaattatcacatgtaccccaaactatatatctattatgcatcaataaaatatcataaaattaataaaataaatattttttaagttagtggctcactctgtagctcaggctggagtgcagtggtgcaatgattgctcaccacagtctcaaactcctgggctcaagtgatcctcctgcctgggcctcccaacatgctgggattacaggcatgcaccaccacacccagcctaaataaatttaaacagaaaaaaagagcaacactaggccgggcatggtggctcaggcctgtaatcccagcactttgggaggccaaggcaggcagatcacgaggttaggagatcgagaccatcccggctaacacggtgaaaccccgtctctactaaaaatacaaaaaattagctgggtgtggtggcgggcgcctgtagtcccagctactcgggaggctgaggcaggagaatggcatgaacctgggaggcagagcttgcagtgagccgagatagcgccactgcagtccggcctgggtgaaagagagaaactctgtctcaaaaaaaaaaaaaaaaaaaaaaaaagagcaacataagcagaaatagctgtttaactttagtaaaatttattgcacaaaagagttttacacatagcttttgaattttaaaacattttatttattcatttcacaaatatgttttgatccctcagtgtagaccagcacagagttagggactaaagggagagtggtggatgagacaggtgtcttcctggagctcatgttctgttgggcgggtggtgttggggagcaagcaacacattagcaagcaaataaagataatttagtttgtaataagtgtagttaaagaaagaaaaagagggcataacagagagtgaagtccacgtgctatgggtgtggaggcagccaggaggactcaagatatggtcctcagggacagactctctgagaagatggtatttgagataaggtgaatgagcactaccgacagcatgtggcgtagcaagacaatggattaaaaagcagcagcttgcaaatgatcacttatgacagggccttgtataattttcctgttctgtgacatcatcttgaaccaggtgaggaaattgataaaatattctcaagaactgggtctgtggaaaccacgcagctcaatgtccttcaagtttgtttgaatggagtgatgttcccaaggtcataatctttgcatgactatgaagaatataaaatacagcacctgattggatgctaaacgtaaaactcagtgttctcaccctgctctctcttctaattcaacctgtttagaacttgcatgaaacaatacccttgcattccacatggatattacagaaacgttatagactcctgctacctgaaattttcttgtctttgcctcagtgagaaaaatgccatgactcttttgatctacctgcaataaatctgatggccaaggaatggatattcactgtcctatcaaatgagagccatctggaactttgtaattttgacgaacatctctattccctgcttctctgagtttgacttttttagatttcacatgtatgtgagaaaagacagtgtttgtctttctgtgcgtggcttacttcactaagcacaatgcccttcaggttcatccatgtcattgcaaatgggaagatttgcttccttttttaaggctgaataatattcctttgtgtatataggaatgatattcctatgcatgtgtgtatatgtatatcaacacttaagtttttttcatattctggctgttgcgaatgattctgcaataaacatgggagtgcagatatgtaatttcatttcctttggatatatacccagagtgggattgctagatcatatggtaggtaaaagggtacaaagcttcagttatgccagatgaatagattctagaggtttactatgcagcacagtgactacagttaataacactatcttacatacttgaaatttgcaaagacagttgatcttaaacattgtcatcacatacacacacatacatacatacacacacaaatgttaactatgtgaggcaatagatatgttattttgcttgatagtgatatatatatatatatatatgcacattgtacatcacattgtataccttaaatatatacaattttcatttttcaatacctcaattaacctggaggaaaaataaactctagccaaggagatgtaacaggcgaaaatgtgtggatttgtaggaaattctgcttaaaggcgacttagctgggaggggtgtttttatgcatttttcctttgcttctttacatcacctggaaggtggatataaaggtaggagctgcagcaatcactttggactttgaaatcatattgagaatggaactgcacgtgaggataatggatcagaaagataaaagcctggtcccttgtgaaactgaagctggcaaaccagcttctggacttatatacaagagagtaaatttctgttttaataaacaataacatcaaaaaatcatttattagtaggaagacttctttaagaggctgtgattccgtagtcagccactgagggcagtcagcaggcactgttgaaaatagaacaaaaacatttagctgaaatgtcttggctttctatttcttttgtgatcatcagagataaaacttcattatgaacttgctgctctttttacttcactggtgtcttatgacagtgatataatgagggaacctaaatactcttttaaagaatacttgatgagcttccaggactcctctaattcttcattaactgaagaattctatattccagaattacagtcattcatatgcatgactatagggctccagaaggcaagagagatataaaagtttcacaatacccaggtacagagcctgtgccagcaaaaacttcattgcttcatttacctgcttctaaaggaaattacaaacggactttgaaaagtattggtttgaagatcaagttatgttcccatagactgaataattaagtggagacaggcctaaccaatgatgtctcactgatctctggcatcttctagcatgaaccaagaatccagaaaaatggttagctgtctgcatccatgttactggaagtatcatcacctgcacacccaatgggttcagtgaactagaagacacaaagttgtgcctaaagccagctccagaaatggtcctggacatccttaaccacatgggattttttaattcctagtacactaacttgcagaccatataaacaccattgcaatattgtttagtaagtagaaatcacatccaagataatatgtattacttggggtaagcttctctattattctgaactctgtcttcatttaattaagaaatgtgagaattggacacaggaaggggaacatcacacaccagggcctgttgtggggtgcggggaggggggagagatagcattaggagatatacctaatgttaaataacgagttaatgggtgcagcacaacaacatggcacatgtatatatatgtaacgaacctgcacgttgtgcacatgtaccctaaaacttaaagtataataaaaaaaaacaaaaacaaaaaatgtgagaatataatgatagctctcgttcttcagtaatacagattttagttacactagagtggaatattgaagatattagaaagtactatgaaaaaatagctgcaaaatctgtcattttacttagagtaggaagtagaagtagagttggagaaggtggcacaaagatgtcacccctttggcaggggtggctgacaataaacaccacagtgtgcacctctgactttctttgcagaataatcccacaatctctgaaaatgaaatgcaccaacttctaatgctattcataaaaaatcaactctcaatgactgcacttaaaaagttttattctaactgaaacttggcagaaatttctcaaatatgcttaagatagtgctatgtaattctaatgacatttttaaaaaatggctgagacaactggatatccacatggaaaataatttagaaccttgcctcacactacctacaaaaattaactcaaaatggattatggcctaaatataacagctaaaactataaaaacttttagaagaaaacatagggaaaatatcttcatgaccttgaagagttcttaggcataacactaagaaaacaagcaaaaacagaaaaaatcaacataataaacttcttcaaaattaagaactggcccagtgcggtgactcacgcctgtaatcccagcactctgggaggccgaggcaggcagatcacatgaggtgaagagttcaagacgagcctggccaacatggtggaaccccgtctctactaaaaatacaaaaattagccaggtgtggtggcatgagcctgtaatcccagctacaggcagaggcaggataatagcttgaacccgggaagcggaggttgcagtgagccaagatcatgccactgcattccagcctgggcaacaaagcaagactccatctcgaaaaaaaaaaaaaaaaattaagaactgtagcattttcaaaggcaccatttagaaagtgaaaaaaaattgaaaatcatatttctaataaagaactcaaatccaaaaaatattaaaaatgcttatatctctataatgaaaagaaacaacccaatcaaaatgggcaaaatagttgactattttacatcaccaaagaagatacacaaatacctaatcagtacacaaaaagatgctcaatattactaggcattagggtaatatgaattaaaatcacagtaagacatgacttcacacccattaggatgactgcaataaaatcacaaacaatgctggtgaagatatggggacctggaatcttcatacatcgttggtggaaggtaatatatacttacatatgcacacatatacatctcacgtaaaaatggcttgctggagtgccagccttcacatccacatcacagcaaaaatgcttaagaatgccccctcagtgaagtcacttttaagcagaatttcctacaaacccacacatttttctcctcttacatcacattggctagagtttattttttccccaggtgtattgtggtatacttgccaaataaaagcagccaaaacaagttggcattttcttaaagtgtttaaacttcaatttgccataaggccccaagttctaggtatctaccctaaatgaatgaaaacatgttcactcaaagacttaggtacaaatgtccatagcaggattattcataatcaaaaagtggaaacaacccaaatattcataatttagtgaattgataaccaaatgcagtatttacagatgagcaaatgctctccagcaacaagagagaatgaatgactaatacatgtaacaacatgggtgctgcatgaaagaaggcagacacaaaatccatatatcaatttatgtgaaatatccagaaaatgcaactctacagagacagaccatagattagtggttgtctgggactggggatggacattgaaattggcttcaaacgggtaggaggaatcttttgggtggtgaaaatattctaaaattaaattggcgtaattgtggcacgactccatgcatttactaaaattattgaattgaataaaccggatggagtttatattaaagtaaactacctctcaacaaaactgttttacgaaacctgaatgaggtatttatttttttatttcaacttttattttagatataggcggtatatgtgcagatttgttacatgggaatattacgtgatgctgaggtttggagtagagatcctgttcctcaggtagtgagcatggtacttcataggtagtcttttttttttttttttttttttttttgagacagagtctcgctcagttgcccacgctagagtgcagtggcgtgatcttagctcactgcaagctctgcctcccggggttcacaccattctcctgccttagcctcccgagtagctgggactacaggcgcctaccaccacgcccggctaattttttttgtatttttactagaggcggggtttcaccgtgttagccaggatggtctctatctcctgaccttgtgatccgcccatctaggcctcccaaagtgctgggattacaggtgtgagccactgtgcctggcccttgataggtagctttttaacctaaactctctgccttccacagtctagtgtccacagtgtctattgttcctgtatttgtgtccatgtgtggtcaatatttagctcttacttataagtgagaacatgaggtacttggttttctgttcctatgttaatttactaagaattatggcctccagctccatccacattgctgcaaagaatgagatttcattcttttttatggctttccagtataccatggtgtatatgtaccacattttatttatccaatctaccattgatggacacctgggctgatttcatgtctttgctattgtgaatagcccagcgatgaacatacaagtgcatatgtctttttggaagaatgatttattttcttttggatatattactcagtaatgggattgctgggtcaaatggtagctctattttaagttctttgagaaatctccagtctgctttccacaatggcaggactaagttactttaccaccagtagtgtataagtgttcccttttctctgcaccctcacagcatctgatgttttatattttaagtgcatgattgaagcaatgcttgagacaggctcttgtggggatatttggtcatatatcaaatctgaataaccgaacggcattgtctttcattttcatccccttcaaatttttttttgtctcaaagtcttcaaacttttatatatatatatatattacaaaaattatttttaccccaaacatttgaaaacgtacagaaaagtagacaaaaataatatgacgcatcccatatattcatcatattaatggctctggcaccaaaccttttctatttttcgtcatgtttatttcttgatagttttactttgtttttggtggtaaagtatatgcaacaaaagggaaactataggctgggtgcagcggctcacgcctgtaatcccagcactttgggaggccgaggcagggggatcacaaggtcaggagatcgagcccatcctggccaacatggtgaaaccctgtctctactaaaacacaaaaaattagctgggtgtggtggtgcatgcctgtagtcccagctactcaggaggctgaggcaggggaatcacttgaacccgggaggcagagatcgaagtgagctgagattgtaccactgcactccagtgtggcaacagagtgagactccatctcaaaaacaaacaaacaaacaaacaaacaacaacaaaaaacaaaaaagggaagctatgtcattttatcattacatgactagcatgtttccctaataaaaatacggttttgttacataaccacagtcagtattacataatatcaagtattatacactcccaattcatttttcctcatcagctcaaaagtggctagcttttaaacaattgaattaattaaatcaagatccttctcttgctcacatgcagttgttacatctcttgagtgtttcttaatgcagagctagccctcctcctttctcccatgtatttgacttggctttttaaagaaaccaggtatgatgttccccctcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaatagtgccgcaataaacatacgtgtgcatgtgtctttatagcagcatatgtaccctaaaacttaaagtataataataataaaaaaaaagaaaccaggtagttaccatgctgaatttgcttgtccatgtcatcatttaacttgttccgttattgccataggcatttttcttatgaactggaatttatttcagtgggttggttagataagtgttcaacctctctctctttgagaggggtgctgtgcacttcacattgcttccacaaaatgtatggttttcccgttcttagtgacactcaattgttcagtgaggtcagatgttaaaatttatctgagctattttgctaaggttgaaaatggaattttctaattgtgtcatttcgttcgcattcagtagatataattattctgcagaatgaactttcccttctgaactaaggttatttggttatcttaaaatacagcagctataggaaagacaatacatttagtggttgttgtctttaatcatctgttatcagaatgaagagttagtgccctggtttctactatgcagaccaataagattcttctttctttctttatatgaaatatatatgcaggtgtgcatatgtaagtatatatgtacatatgtgtatatatctatatatacacacacatgtatgtataaaattaaaatgaactcaaaggttttcaaaatatttaatggttatcaatcatgtgcaagcatcactgctgatactcaattcatcccctttggctgacgagagccgctttatgttgattcctatgtcattttgacaagaccccattcatgtttcagactcacctcagacatttcctgcctcagaccttcaatcagccactcctccaagaagccatggtcccttttagtagtgaattatatttaaaagaatctacaatctagatgttagaggggcttgttgctattgtttgctcatcacttctgggacttctcagtggaaagactgaaaattcatactttttttttgaagtgtgtaccaatagttttttgtgttcttttttttttttttttttgagatggaagttcactcttgtcaccaggctggagtgcaatggtgccatcttggctcactgcaacctctgcctcctgagttcaagcaattctcctgcctcagcctcctgagtagctgggattacaggcacccaccactatacctgggtaatttttgtatttttagtagagatggggtttcatcatgttagccaggctggtcttgaactcctgacctcaagtggtctgcctgcctcggtctcccaaagtgctgagattacaggtgtgagccaccacgcataccacaaataccaatagtttctattggaatttgacatttcaaggattttatgcattttttaaaatttagggaaaggacttcatgtctaaaacaccaaaagcaatgccaacaaaagccaaaattgacaaatgggatctaattaaactaaagatcttctgcacagcaaaagaaactaccatcagagtgaacaggcaacctacagaataggagaaaatttttgcaatctactcatctgacaaagggctaatatccagaatctacaatgaactcaaacaaatttacaagaaaaacaaacaacaccatcaacaagtgggcaaaggatatgaacagacacttctcaaaagaagacatttatgcagccaaaagacacatgaaaaaatgctcatcatcactggccattagagaaatgcaaatcaaaaccacaatgagataccatcttacaccagttagaatggtgatcattaaaaagtcaggaaacaacaggtgctggagaggatgtggagaaataggaacacttttacactgttggtgggactgtaaactagttcaaacattgtgaaagtcagtgtggcgattcctcagggatcgagaactagaaataccatttgacccagccatcccattactgggtatatacccaaagtaatataaatcatgctgctataaagacacatgcacacgtatgtttattgaggcattattcacaatagcaaagacttggaaccaacccaaatgcccaacaatgatagactggattaagaaaaagtggcacatatacaccatggaatactatgcagccataaaaaatgatgagttcatgtcctttgtagggacatagatgaagctggaaaccatcattctcagcaaactgtcgcaaggacaaaaaaccaaacaccgcatgttctcactcataggtgggaattgaacaatgagaacacatggacacaggaaggggaacatcacacaccggggcctgttgtgggatggggggaggggggagggatagcactgggagatatacctaatgttaaatgacgagttaatgggtgcagcacaccaacatggcacatatatacatatgtaacatacctgtacgttatgcacgtgtaccctaaaacttaaagtacaattaaaaaaaagtgtatatatatatatatatacacacacagtagtatatatacatatatatatatacacacactagtatatatacatatatatatatatatatacacacatacatatatatacacactaaggcacatctgttctcttagagcttaggataaaaagtacatatgtaaagtatttagaaataattatttcagttgtataaatgccttacatttttgttatatttcaagaatttctataaattttcaagaattataaaagaatttcatacttttatttttctcttatactgaaaataaaaataaaaataacataaacataatcacttttcacttatcccactatatatgctactataaataaaaatgagtatctataatatataatatataaacaaatatatttaatgtgatgattaatattgagtgtcaacttaattggattgaaggatgcaaagtattgttcctgggtgtgtctgtgagggtgtcaccaaaggagattaacatttgagtcagtgaactgggagaggcagacccaccctcaatctgggtgggcaccattaatcaactgccagtatggctaggataaaagcaggcagaggaacatggaaagactagactggcttagtcctccagcctacatctttctcccgtgctggatgcttcctgcccttgagcatcagactccaagttcttcaacttttagacgcttggaccttcgaccacagactgaagggtgcactgttggcttccctactttgaaggttttgggaattagactgactttctttctcctcagcttgcagacggcctattgtgggactttaccttgtgatcacgtgagtcattactccttaataaactctactttatatatacatctatcctattaattctgtccccctaaagaaccctaatacatatatagagactagactccaatttttaccttctagacactactaacctttcagaagagttgctcatcttctcggagtttcagcaatctcctctaaaactgtccctactgaaaaggcagtcctcaataccaaactcacttcttgtggctgttttcctctggaatttggtcctgtaagttttcactctagctcctaacagccatgagcagatgttttttacacatttaacaagtctttctagttatcctcagagaaagaatgacttgtccaaataactagccctagcacagaaatcaagaccattttaaaaaatattaggtcagtttgtctattttactgactttttttttaaagaaaaaacttgtttattacatttactgttcttttggtctattttctatttcattagtctgtttatattctcccttagaagtaacttgaacttattttctggctgtctaaatgatatttttctttatctttacagctcaaaaattttattagactatgttgcatgttgaccattctgggtccatttttccaggtagggttgtgccattttaatatgtagtcattatgcattctttttaatgacaggagactttttttgaattagtgttttattattaatacttattctcatcaattgcttggctttctttttaagagaatttagttatacatgtgtttcatcatctttgtcagacatctatacatttttaactctatttgtcttattccttaatatttttgatttcccatattatgctttctgttgtgtttatcctctgatgtgttccctgtcatttcattttaattttagaactcttcatttttctaactttttccaaaatatgccactttttgtttcacagatttgtgttgtttcatcattttatttctgatttatactgctctttcaaagctttaatcatttcaaacaaaaaaatatagttttcatatgatttgtcagtattttttgtagttacttataatcaaaacttttttaaaaattttcattctttttcttgtgataaagttgtgttgggttaaatctttttcctttttgtttcattttacaataagatagagattcttagttaattaggagaaggttcctgcaggagaggatgaaatgagtatatttttccagtcttctcccttgatattaccttcaaggactcgacatttagcccatctctcagagctatatgggattgaactgtatgggcttccacttctggccatgtgtttcctagaacactgttttttacattctaaggctgtgcgtgttgtattttcttttgcagtatttcataggatggaattctctagggcctcccctggttcccgagccttctctgttactctttgtattctactctggctcaatttgatttctaaattgagccgttcccctgagagtgagtctctgttcttctgaaaggagtacttgctgagtacttccactatcttcaaggacatagaccatcactggcctgtgcaaacattaccagccactctaatggccttgtgactcatctccaacctagacctcatgcagttctatcccagtgttgtgaggactctaagacacaaagaattctcctctgcttttggagatggggacccgttggttatttgcagttttctgacactaccataaacccaacaggctgaccccttctactgccttccacctctgctgctggtcctgttgttgccagtaatccagttgtgttgaaggtgccatccatgtacttttttctttgtcatcctattttatctgtgttggtttcaggaggagtttggggtcaaacaccaacatgtttccaccatgacccaaactccagatgtacatttttcagtatatttaaatctaatttaaaatgaaattaatttctcttttccttcaaagcttgacatgttagaaatgcattctgtattcagtgtctacagtctcatcttttagcattaacaaatttcttcctcaactgctttattaaaatttcaatgacaaaaaatattgagttattttccacatatggtagactctcatatgagcctttttgtggcatgtgactctgtggacccctcccttctcctggcatctatcacctccctgtcttcatctatactgttagtcctgaatgctcagtcttattccttggctacttttcggcaggtggcttagtgtatgatattccctggctggattatacattgttgctctcacttttccaatgctcactaggcaatcctaggactcccatggtgacaaaatgcttgtgactacttctgtccatttttgaaacattagtgaatcactccaaaacaaaaaatgaacaaacatcgtgggattaaggaaagtaaacttgcctttccaaccctgagagatacatttaaaaatcaacacttgatgattcagcatgaagataaaaaaggtcacctgaaacagaaagacgggctcttagatcatcaccacttatgtcatcatttggagggagaaatgcttatttactaattttgcgaatcccaaattaattttatatcaggatccccctcctacctcgaatccttcccctttcttttctgaacatgccattagaaaatttctctttaacacaaagaggacgttttctaggattttctgaataagcagaatattgtgctctccttaaagctatcatggactaagatgatagttattattcattttctaattcatttttcccccaaaagacatgataactataaaagcaagggagaaaatagcaattgacttgtaaaagaacagataaagaaacaaaaatacttgcaagttcaaaggaaaactaatttaattctgacttgtatttgtgctggaccttgaaagactattggctattttgaagatgtaagtgatgaagagaaaaatcccaacagtacattatcaaggacaaaaagtgggtgctcaggcagtgatgttttaaattattccaatgttcaacaagttcccttcacttcttcccataaagcattattacaaataaggtacttctcaaatattgatagcaagcaacctttggtcacttccatctcactattacaaccttataggatatttaccacaggggggcaattttatattcttcagctacaaaggcaaaggttgggtattttgtatttggttttataatcaaatcaaatgcaatttgactgcatttgagatggatatttgggatggagatggatctttcactcctaatgtgctccctgaaatgctaacgcatcattatgtgaatgtgtcaattactggtttgacaaatgtgaaatctgtatttctatgaaattgtactcatattcatttaaaagagttttaaaattcctaaaatattttggaaaaggaattgaaggctccattttagtggcaacactccacaattttgattgagtcgtctcaggacactaacaaagaaatagcagacatagcagacagagtcttgataagtttttacctgatacaaaaagtctggcgctgttgctctgcctcgtctctccggtgtatcgatgccgcgtgatgcagcggtagttatacaatccatcttcattctgtacatctttaatatacaaggctcccgtggatgtgatgagaaatctagatcctgaaatagaggaaaacagtggcttggttaaaagacaatgaaagcaacccaaccacacagacaaagtccttaaacagttttttttttcccccacctgaagaaacttaatgaaaaggctaaaaatgggtgcgtgcgtctgcgtgtgtgtgtgtgtgtgtgtgtgtgtgtgtgtgtgtcaattaagggtccaagctgttttaattttttgactagcctacattaagggtttttagtccttatgctatacaataaatatatacttagcaaatctaacctcataaacttttttttagatcatgcatttatcttacagcaacgaagttgtcatataattggtatataccgaacacagaagattttcttggatcattacatttcccttagaatgtgacaaattaagggaatattaactttttgttgcacatctctagcttatgaaagtataaacttttgcctcagtttaaaatgtttcaataaaagcacaaaaatattagactacaaagcaataaaatattctacaaacttcccctaaaaaggctgtcttatttcctcacattaataaccaatatttatcactatattctatgacacatatcaattcttcccagattcagtgttttagaatactctgttatttcttaatcactaatttttaaagggactgttcaaatcactaacaataacaattttcacctcaagaaaaaaaattcatgatcagtcattccccattatgtcagcacaaaacaatgtcctatctgtaacctctaatttttaccggtaaagcttcagttgaacagaaagggccaacattgagatcaaatatcagtgttagtttaagagggcaaaaatgtttttttccctttgaaaatgtaacttttaaagatatttttcgctgttcaattttaattggctgataaaacaagttggagcataaaggtaaaatgtaaatgatcatcgtaagtggattctataatttccctaagataataaaatttctggtcttttactttaaaaaaaaaaaaaaagtagagctgagagtgcctcattgcaccttcccggtgggtaactcagtacacctcctgccaccgttagactcttctatgggctatttctgcatgtgatgtgattccactagaaagaatgtgatttttatctttgaaaaaagactaaaatgccaaataatcaacttttattgcttatttttctcaggttcagttgaaacatcctttagtttatttcagtcagaatttccaggagtcttagcttcattgcttttgagctttacatatttaaattgtaaagataatttcttggtcattttctgcagtaactacacatcatgcataggtcagtttctcagataaattaaaaatggtttatggtttttttttttgagataaggtctggctgtattatccaggctgtggtgcagtggtatcatctcagctcactgcagccatcacctcctgagctcaagcaatccttccacctcagcctcccgaatagctggaactatgggagtgggccatcacacctggctaatttttgtatttttttatagagacgagatctcaccatgttgcccaggctggtcttgaactcatgagctcaagtgatccacccgtcttggcctcccaaagtgccagggagtgtaatccctcccaaagtgggattacaggcatgagccaccatgcccagcctaaaaatgatttatgaattatcatgagttaggagtaattccaaagaacacagatgtgaaaaagatcataaaataacagagcaaatactgaccttgtataagcttttcaaaggagcgcaaattaattattaaaggtagtataaaatatctttaaagtaatatctatattaactttccaaacaattccagttagacatttagtttaaaatatgccataaataatgctagctattagagaagctgaaaaatctcctaatgctgtatattccagataattttgctttattattccccaaaatgaaagcaactaaaaataccttttaccacttgtcatgtgtcatcacacaccagcctttcttatgatacacattgtgtataatggaaacattatttctctttcaatatattttgcatacttacataatgctttaataatcagttcctttaaagtacagtttgatagacagaaaggaaagtcaaaaaaaaaaaaagatgatgtatgtaattcctgtcaccttcttagcgtggagtattttcattagaattgataggccatgagtggtggcaaaatacaagtgggaaggattttgtgtgccattttccagaaaggttgagaaatgcacacagatagcagcagcctgcattattactgattccagagagggctctattctctaggaacattttgttcttgtaatatctaacatttttttcgtttacccacttacgttaaataaggctttagggcgtatcatttcagaagaacttgaacctttgattgtcttaagcattttttgagatgtttacaggaatgaaggagttgacattaactgagtttctgtgcgtaaacccatttaagcctagcgtttcattattggaacgctaagcatgtggcaattatttatttcctgctgctcaaggtcattgccaaggtctgattgcaaaaatttaaaaaattgcaacctcaggcataaatgggttaatttgacctcctttgtctagtccttcatttctcaatttatctcatcttgaaattgatcaacattttaaaacataaaataaggttgaaaagtaggatcttttaattatgagaggaacaggtaagtccagggtccttgggtacagtctcaactcaggagtcctgtggaactatcaagggacaacaaggacacagctaagtcattagagcaccaaatatgtcagccctgtggtaacaaggaatcattttaactgctccctaacttgccactgtaccccacttgctaccttatgccaccaaaggtttccatgtcatatggattaaatggtttgttcatgtccttcaatgggattaatggatgtgcttctgttaaaataggcaaatgtttaaatacaatttattggcagcaaaaagtgcaaacacacaattctgtctcattctgtctccctttgtgtgtctttctgttttattttccttggaatactattagcattttaaccggacacagttctaaaacatagttcatactttttgtcatgttagacacactgcaatttagagcctactgaacagggaatgatttttggattttgagtcatcattttggacatcgattattgagccatgctgctcagttaccagagggatgtctcagaagctatgtggcatctcaagatgcatggaatggtcccagactgccagatgttcaagtctctgagcttgtctttattagcttttctgcttcctcctttactatccagctgttatatgttacttccctttgttatcagtatctttgtcaacacacagtgtgatgcattcagtatgctgagagttagaaaacagacatatcaaggcttttaggactttgtataaactaagagtaaataggttatgagcaagtaacatagtggttttccaacatcagttaacatgagcttacatgttagtgccactaaaataaatccagcgcttggtgtcagttcagtcagcctggttaagattagcataggggccagtgggatatttctatgtagggacacaaaactaccaaagaaaatggggcattagcccagtaggaaaatgttgcagaaaccctcagatttggagttctacagccacgttcttcccattgtcacggagctgagccgcaaaaaacactcatagagcagtgggttctgaaactcaggcacaacaccattttgggttttcttcaaaggcagatattaaaatagcagcagttctagaaatctattttgctgaactatgggttgttaatgctgaaagtcagatctttaagatctgagccgcagaaagcaggcatgcatgatctccagaaagaggcacatcagagttgattctagaaaccagcaggtgttataggtggtcaggaaacagagccaagtgatgcacccattcgttggaccagcactgtcctaggctccagaaatgcaaaaaggagagagacagcccctatctctagggagcttataatctaaacagatttgagcctttgggtttaggaacatcccaagaagttgaggaaaaaggatagaagggaagaacctggagagcaatcaaggaagtggcattgtccttgtctccctgggatgaaggggctactgatacccagggaggaaaactggtatttatccccatacctgcttttatccttgtgtgttattctaatacaaatacttaattttatatgttaaagtcctcatcattaatgtgcttgttcaatcttctcagctaactttttcttgttcttatgaagaatcaaattaaaagattttccctggtttgaggtgcaataagctcatccactttgagagatttctcagtgtggaagaaaaaacctgggctttggaagccagtggatctgaactacaaaacggtccttgtccctttccagctgtgtggcctcagtctagtcatttaactctaaactttgctttcttcatctagaaaaaagagagatgatgagtaatctctttgttctgctgttgaagatcaaattaaaatgcatttatgtcatctagcagatagtcatgcatctactgcacagcagagtgactaagctgaataataatgtattctatatttcaaaatagctcagagagtaaatttcaaatcacaaaaaaagggataagtgaggtggtagatatgttcatcatcttgatgtaatcatttcacatcgtgtatacacataggtgtgtatatatagacacatacaaaatcaacacattgtacccaataaatgtatataacttttcaattgaaaaaaatattaataaataaaaaattaaattggtatctatcctagtaaatgccatgtttgttattctgctgttctggacaatccacaggtgtataaaatgtagcctttgtgagccagacagggaagatcccactgacataaacatagcagggccccctttcaattgcttgtttgcttacttatgaaaggcaaccgcatatattaaagaaagcatctgagtggtaatgatgtagatgaattttacatcataattctgccatttggagctatttcaccacaggcaaaatatttactaaacctctgagccaatgtcacatgacagagcattggtaaacatagaaagatatactgagtccatggagtatttttgtataccccagtgaaaggcttggggaaaggaggatcacagacatctgctatgaactgaatgtttgcatctgcacaaaatttatatgatgaattcttaatccccaatatgacagtatttggaaataaagcttttgggaagtaattaggtataggtgtgattataagggtgggaccagacctcactttctctttccgccctgtgggatcgcagtgagaaggcggctgtctgcaatccaggaagggagcccccatcaggcaccaaatctgccaataccttgatcttggacttcccagcctccagaacagtgagagataaatttttgtggtttaagcctcccagtccatgctattttgtgatagtagcccaagctgaccaagatattatcttcagaagtcttttccacagtagaaatggatattcacagaaactcagggactttccccaaaatcattatcatgttacttgaacaattctccctggcatatctgttagtatctgagtataaaaaaaatatcctgaagttctcaaaattaatcatttcttgtccatcatattttatctaacaggaaggccctctgcttctacctccaaaatatatcctgaatccatccactttcctccctcaacactgtaccacacacatctaaggattgtagctttcaaactctctgtgtccacttctgcttccctacaatttaatctctattcaacatgcatgagcatttagcaatatacatcatttagtgccttgatggaatcccactagacctaaccacttatgatggtctatgatagtttgggctttggccatatctccaaaagcttccactccactctctccttcttccaccatacccaggccatgctgtacttcttttaattgctctgactggaggctctgagcccagatctctccctggatgggtccttcttgtcatcctggcctcagtttttaagtcaaatttccagcaaagtcacatgatcatggtcattcatgatgagagacttggttttattatacctgtatgtgacgttatcttgtacatgtgcatgagattggtttaacatttccctccttcatctagaatagcaagaactcattttgtcttgttcaacatttcatctccattacatagaacagtacttggctatgacatcctaaaatatttgttgaatgcatgcatgggtggatgaaacagtctattattgcttgtattcaaaacatcctttcctaggtctcagtaaaaagaaagctaaagtacctttttttagatttcggcacatttcctcatgtagactgcataaaaagagtttgttctcctccagagatgaatatattcttatatgaaaatgagcatattttaagattgtgatgaattattctttcattatgctccctggctttttactgtgtggttaagctgttagatcttcagtaaaggcaatactatttgggggaagattttaaaagcatatgtcatttttcacttagagaaatatatcttagagctcttgttgttgtgtttttcctattgcagtctatatgaattgagttaatagcaattgaaagaagagatggctctgctaataagatgttaaatggtagcacaagcacgatgaagcttttctcagctgcgcctgccgtcgccaattgatggccacactgtgtcatgaaactcagctttcttcaaagccgtttcaataacagtttctgaaatattagaggaacataagaattaaatctaagttctaagtatatagcattagaaaccacatgatcctcttagcattaactaaaatagaagtggaaatagaagatatatatatatctatatcatatatatcttatatagatatctatatatcttatatagatatctatatatcttatatagatatctatatatcttatatagatatctatatatcttatatcgatatctatatatcttatatagatatcgatatatcttatatcgatatctatatatcttatatcgatatctatatatcttatatcgatatctatatatcttatatagatatcgatatctatatatcttatatagatatcgatatctatatatcttatatagatatctatatatcatatatatcatatatatcttatatagatatctatatatcatatatatgatatatataaaggattacatgcaggcatgaacgagctacagatatttcctgagcaattgagttgccagataaaaatatgcacatgttgaaagctgcatataagagaaaagaagagccccctaaagagaagacatctaacctgacgttatgagctgaatttcccccttcctcaaaaatttatgttaatgtcctaacctgcagtacctcgggatgtgactttatttggaaatagggtcagtcactgcagatgtaatatcttaagatgaactcatacttggatagtgtgtgcccctaatccaatgtgaccggtgtgtccttataaaaagggaaaatttagatagagacatggatattaacatgaatcctaatcagagccaacaggttctaggtggaggctaccactgctttcggcattatttatgttatgacacatttagttcttacaatgaccccaagaggaagatactgttattcccatttttcagatgagaaaattgagaaacagagaagttcagggacttgccccagtttatacaactagaagtatctgtgccaggatggtgccctggcttgctggctcatgccctcacgcaaatcgctcccctgggtttgggccatggcacaagtgtgagacggcaaggcatgggcaagcggaggtacaaccagagtggggcagaagccatgagcacagaaagaaatttaacctaaaggttcaacagagctggggtgaggagaagaagatgccaggtattgattctgagggacctatggggttggggtggccttggtagaacaaaggagttggggtaggggagattctgtttcagaaaagataagagctcagctgtgagcatgctgagtcagttaaaatcaaaaaagtcaagctgcagacagggcgttggagaccaaactatgcttgttgaggagaagcccttcatgagaactgaagtttagtaactccccaggaaggggagtgaaggaaggcgagtgaaggaagaaggccaagaaaagacccaggaaaggagtgagaggaggcatggaggacacaagccagtgtggcgctaagaaagccaggggaggagaggacttctaaaggatgctgcaaagggcctcagctccctgccttcctattgccatagccttgagtacatatacaacctgtacaaaggggcaatattgcctttttgggaaaatcatgatattaaataagaacatccatgtaagaacctgacagagaaaagcactttagagtagctctaatctgtaataaaatatgataaaatattcttgctgaaccaataaaaatattaagtgtctaagagctagaaatgcacaaaattgagttaaagaacactccacgtcattaccaaatgacataatagaagccctggataaatgaagaggcatatccaaatctaggattagtcaacttaatattgcaaaaatgtcaccttttcacaagtgaaatgaattacgttttaattaattgctgaacaaaatttacttagaacttgaacaaatcaatgtaaattaaaatgagagattcttttcatacaggagattagaacaaaaaataaaatgtttgaaaataagtggtcttgacaaaaggtatgggaaataaaaacctctataggtgggcatgtaaattggtgaagccttttgatttttgaagggcaacttgccagtatatttcaagtgtgagacttgcatacttttcaatccctcttgcaacgtcaaagattatcctatggaaaaactcagaagtgcacactttgacgttcacccccaaatgcacggatgcataatttaacaatgaaaacttatttttttttttttttttttttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggccaacaatgaaaacttatacataaacctgaatgccaatcaagggataaataagtaaataaattagggtacatctatactctgcagttacataaaagacagtaaggtatatgtacacataccctgcagaaaaatctccactacatagtctaaagtggttacataacaatctgtaatgttatgtaccaaaggcagtggtatatgaataaatttgtgtatgcaaatgaacagagaggcctggatcagcagatatctgcccaaatgttaactgtggttgcctctgaaatcatgagtggattagaggaaggggaggagaaattatgtttcatttcccactgtcacgtatttgagtatcttaaaagaagactctattaatgtgcttcttgggtagttaaaatgtattttggaaaaagatgtcagtgggtggtgagcatatggacacagtagacgtaaaccaaacccatgtaacacacaacatagaaggagataaatttaggatgatgttgctgtcgggagtagatgcgtcaaagagggcttttattatgcttgcttttcaagctggtcgctacctggacttgcctaaaagcagaaggggagactttcaatattcaccctggtctttgtattccctcccctccaaatacctcacacaaaagttgaatctgccatgtagctgatctctgtctcttcctgaacttctgtgataattccccatttcacacataattgcatcagtccagttgatttgggtgtcagagctgcctcctcaaaatggcagttgcctctctgaagacaaagggatcctcttgtttgccccacttacctgctgcccccaaaggtttgcacagtgctaaattaagtgactgtttagaagatatacatacttcgagtttttttctaaaaataggatcagtaaaataagggatcatattgagggggcagagctctcaccatatcattttatttaaccttctttggagcctattatgtttatgagagtatcatcaagatatccaagaaataatgaagccccagcgtggatcttgagccgcctggaagaaatcatttggctagaaataacaccatcacatggggcatgaggaataagcttacaattctgctggatccagtatgtaaggagagatttggtgtacatattttaaattctctcaaagcaatttcactaagacatttcttttatgtaaataaaattctctcagtgaaattctcctgcagttaaatgaggctcaattatacactactaatttaagcctgcatactgcattccaactgtatacctaattaccctatttagtttgttaatgatcagatctttgtgcagatattcaagtctgtcactaatctttgctctagttagatttctagttgtttaaaataatgaatccttagaaagaatataattgtataattcctttacttttaaatgaatcacttcaagaattttttattaaagaaccaaagaagctcgtaaaacttataaattgtatttatttatttatacgatgaacaagatggttttggccactgacatttgaaagcaaatatttcagttgggaacacagacaaaaagagtacattgacaaagaaaataaatccactctcataaatgcatttacatgaattgagaaacagaagttgactctagtaaagagaagagctgtttagatggtgggggtttggagtggggtgtgtatgtaaggatttctgaggacgtgcacttcagcagagccacagaaggtaggaagataagaagggattattcatggataagtagagctaagaacaaggttaaaggaaaagtatgtttgaggcgggaaaaactgtggcatatccaaggaactgacacaggatatggtttgaaaatagaactgaggccgggcgcggtggctcgcgcctgtaatcccagcactttgggaggccgaggcgggcggatcacaaggtcaggagatcgagaccatcctggctaacacggtgaaaccccgtctctactaaaaatgcaaaaaattagccgggcgtggtggcgggcgcctgtagtcccagctgctcgggaggctgaggcaggagaatggcgggaacccgggaggcggagcctgcagtgagccgagatcgtgccactgcactccagcctgggcgacagagcgagactccgtctcaaaaaaaaaaaaaaaaaaaaaagaaaatagaactgataggacatagaactcgcctgaatgccaggatgaggcaaaggcgatgaggaccaaggtggctgctaggtcttggtgaagagccctgaacaggtgaagagtcctcctgccaggaataagaaccacggggtgtggcactggctgtccatggctgacttattttggactttggggaattgaaagtagccctttatagagatatggaaaggggaaggaagagaatgctattggatgtgctcgttgtatcaggcggactcatgtttagaagaggtacatcagcattatttactgtcccacaagatttctgcattttggggctggaagggaatgtgtatttcaggttgactgtctgttccagttgtgggtgcacaatacagtgctgattaaaaagcaacacatacaaaaaggaaaaaataagtgaaggaaggtcagagcacggcacttcaacccacagtgactatgcttacctggtctgtgttagcaacccaaaaggaatttaagacactgggcttattggcaaaacacattgaaaattaactgtaaagtttgtctacctgatacagatggcataggattatgggaaagaatctggaaaaataggaaccaccataaagaatgaaactaacactatgttgtggccacttaatattatgggataatggtttttcacactttgggttcacctactaataggttgtgaaatcagtttcatggattgcagctttactttttaaaaaaatgaaataaaagagcatagaatgtatcagtgtgtatcaaatagtggtgataaatattctgcagcttgtttcagtacacctgtgcatacataaagttatgtgtgtgtttgtatatttatgtgtgtatttatgtgtatgcattactgagttctaagataaaatgtctttattctatgtatctcttactgtgagtcagagcaaaaaatgtttgaagagcctttttcaacatcttagtgatggaattgttacttttctgactaggcttccgtttcaaagcaaggctaatcgtcttttagcatcagctggtataccttggattcttaaagttctctctttaaatatttctgcattttaaattaaagattcctgctttagcaagtcccctagttcttattcctggtagggggactcttcacctgttcagggctcctcaccaagacctagcagccgccttggtcctcatctcctttgcctcatcctgacattcaggccaattctatgtcctatcagttctattttcaaagtatatcttgtatcatttccttggacatgacacattttttcccacctcaaacacatgctttgagaccagcaagtctataaggccataggcttggttgcatttataatgggaatagcagagaaagcagtttatttttttaaaactgcaacatcatttgaaggtcttggattacatttgtttcccaatgacacgtgatgatgtcaaaggaaactataatgagtttactgagctatccatacaaatgtacatgcaaatatgtatacttacaagaacacgcaagggtagaaaccatgtcagatgcggtccctcgtgtcactcccactccactgccttttggtttcaaatagtctgaccccatgagaatctttgagactgtctttcatgtcacagagccttgcactgtgagagtaactcaattccctaaatgacttccccagatctagcttatcacaaactccattgccttgcaataacctttgtaacaaaatggtattaataaaatcatgtagcaactgcccatcatatgcagacctagtaatggaatccaagttacctaaaaggctaattcctaatgagaaggaaaggaaacataccataaagtaaaagtgcaaacaattgcaaaacagaggcaaacagtgtcagttggatatacgtaagcgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatggtatgcagctgataagacgctatagagaaatgatatccggacacatggtgagactttttctcctctgtaaatctcaattcttgtgattctttcaaagggaaagccacagaaggtaccagttatccactcactgacttaggtgcctccactagaattctcagcacgtttttgcagaagtaagttatcttcactattgctctaacacttcttagtctcctttttctttcttttctttttttttagacaaaggaaaagtaaaccgctggtttagagtctttggaaggcaattgtatctgactagaatttaatattattgtttttctttcattgtattgcatttatctgtatggctagttaaactgattttccatttaaaagtagtaatgcatttttttataattacattgttttaagtaaacaagaattattcaaaggacaaaaacactagcacagatggcattcaatgattgcagatatcataaagatagttcatgaatgacaaagatttgagaagtactgtgttcacgatgcttcctggaagaggtgggttatacagtgtttcttagagaaagggataggggtctactgctaggagggaaagatgaagctacttagggggactaggaaacacgcagttggcctgccctctgcttggagatcacagccaaggaaacacaggagaggcaccccctggaggagctccgtgggctgcagggctgacgtggcccaggtaagtgggagttcagggaggcccacaggttggtgctaggatagtggcagatgattttcattgtcagactgtgagacaaaaggtagacataagggaggcagaggtgaaatcgggatggttaaaacagagaatgctgagagcagagcaaggcagttgctaaagctgttactaaaactggacagcagaaggcctggcgtggtggctcacagctgtaatcccagcactttgggaggcctaggtgggtggatcatcagaggtcaggagttagagactagcctgaccaacatggtgaaaccccatctctactaaaaatacaaagttagccaggcatggtggcccatgcctgtaatcccagctactcgggaggctgaggcaggagaattgcttgaatttgggaggtggaggttgcggtgagctgagatcgcaccattgctctccagcctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcatttagttctgtattttgttcaatgctgtattcccagtccctagaacacatacagagtagtggttcattaaatgtttgtcaaatgaatgaatcaatgaatccactcatttcactgctgacaagcagtaaaactgacgtcaattttgcacaaacttttacaagattcctcggcacccacataagagacgtactaatacgtctacctagaaatatatgtattgcattgacagaatttgtgtttttggttttgtgggattctctgaaatgctatgtgacttcttaagggcttggcacatgctgtaggctgttaatgtggctgaggggtttggctctcacatgaccactgcagacaggctgtgtgccacctgctcactttgtaagcttctcgtccccctctgacagctctttgcaatgctttgtcttttcttcaaaactttatatatatttttttaagaagaaaaatctgataagcctttgtcagaaaaaagtgggtgaattcttccaagtaataaaataatgcaaagtataaaataaagaggataaaccgattcacagctaggaatacaaggtatctttggccaatgggattttgccttcgtgctttcaagcacagtcactttctgtgcaaggttgtaagtgttcaccatgagctttaggtggatctagccctgtaacaacaaatcactagtaccgctggatcaagattagtgtacatttgtgtttaagcaatatcatggtccattaattacgtgcactgcaatttaatggccttgcagatcttaacactgtgcttttatttcatttttgcctaggcccgcctcaccgctaaatataaatggaatgaagcacttgaaaacaaaaagtataaaaatgtgtatatttttcattgcaaagcaattcttaatggattttgtaaactttgcaaaattaaaaggaaaatactgtcaggacactaagcttcttcccaggttttcagattccgaagctttagttgagggcagttgaagaacctacaaggctgttccggagacctttgtgaatgtgaatgaacgccctttgcttcaaaggcacctgcctggtgctgaggaatcggccttggagccgccgcccacgccgggccgctgcgggagaacactcggtgccccctgctggtcagaccgaggccccgcagcgtggcacagagagctccacggcacgcgtggtgtgggaactgcaggctgaaaaacgctcccagaaatgaaatagtgagtgcccgtggatctggcaccaccttaacacttcctcgttaataacacatgatttttgctttattaacctataagcacttcctatgtttacacttcttgggttttgatagaaactcgtgatcagcaaaattctttcaatgaaaatttgtcaaattacttctccacttaaaagtggaaacagtgacgtttttcttgaactccacgtttatttatattattttttaatttcatttttgctttacaaccatctaatgaattttctttagataaaattccctctaggattttaagataaaattccctctaggattaagttttggtcatttctctcatgaaatgtatgtcagattacattatttggaaccttatttttccatttttttttcaggtagtttaatatagtcagtgaatcagcagtgagttgtagcaacttccatttctgactatgtaaaaaactaattattttgaaaactctccaggtataagaaacttagacaagctgcataaatctaacattgacttaaatgaacagcaggtttctcaggtaaggaaagccctctgggctctataaaggaagagggggggtgaatacctaacagcaaagatcttgttgatactacctataatttccctgtgacatttgcacatttagggggaaaaaacatagttttaacagcaatgaggaaatggaaggctgttagtcctacacaagtcctacacaagagaagtctgcagaaaagtacaacttcactaaaagattggacctccaaaaaaaaaaaaacagcctttgcaaatacccttgccttcctagcctaagctttgtgtagggattatgtctaaccatagtactggccttgctctggtttgggatttgtagtctcactgtctccagggtccagtagacctcactctagaaaataacatatagtgacttcgcttctaaggacatctggcagaagcaaagacaaataaatcttccctggaggaaggagcactgagaaatgtttacagatgaagcttgactcctcccttccaatcttgagcttccagtaccaaacctctaacacattagagaacaatttatcataaaaaggagtcagaagaagcaatagaggcctcagacaatgaaataactcgacaatgtttacacaataagtattttaaatgttgcaaaactatagaattgaattaaaaataggataagtgaataagagtatatcataaaagatacaaatattagataaacaataaaatatttgcagaatgggcagaaataaaacacataacccttgacataaatatttatattagacacagttgggaaaaattagtgaacaagaaaataaatctacagaaattactcagaatatttcctagagagaaaaagaaacatatggaagaaagaaagatacatatgaaagaaaggttaagagacttgaaggagagatagaggaaatccacagttcaaggagagggtagaaaaaaatggcagaaaagcaatatttgggaaaacaatttggaaatttcccagtattgataagaaccgacagtttgccaatagcaggcttgcgcctggaactaaaggatgtgcttccagaaaagaaattgtactcaataatgagatgcaaaaagaagggtggagaaagaacgaggtatgcgtgagtaaccctaaacaaataatgactgtataaagtgataataatggcaaatatgattgatataaaaagttagatgcctctagaacactggaagacaattgcatttcagatgggagggagatcacagcagatggtatcatgaagtcctgtgtttctcggtatgaggtaggtcagcgtgctgtatttgtgggtgaagaaaagcaatctctttagtgcttttgacacttttccacaaattccatttcacccacatcttaacctggcaggcatctctttactgtttgagaaaccagaccttgctctttacagtttccataaggctgtcatggtcattactctatttaatcttcataggaaaatcacgggagttaaggccattttaaaccccccctcctccactgataaaccagctgtgttctttgaaaatatttgatacaactctaagcactgcaaacttcacattctggaaagtgtgttcaatcctactaaaacctattacaatccattcaaatgcacataccctattggagtagggtggtataaattcaccactctgggtaagcaaatcttgctttttaatttcattccctgtattttctccccacattttcccacttagtaattgtttataaattccaggtagaacatgctcatttcatgttggcttttcttagcaattcttacagtaaatgtagtgtacagtgtaactaccctgtgccatttagaaatgggtgggatacaatatggtaagtttactctttccctcaatgtaattcaacatgtatttaataaaagtaggatattcctgcataaaagatgaatagaaatcccccgtgttttaagataatttgctctcttcttgagagtacaaaagggttttctccaatgtacattttgctcatttttatatcttctgataaattattctcatgtcatgctgagaaaacttcacttgtcatttgagcaaggaaatcaaaagtcattataaatgtctagcattgaaaccatctttctttcatttcctgacattaaattttaattagagaatattcttttaaatagccaatattttatgaagagaaataacaaaaaagaggaccgttaaaaaacagctaatgttctaaaaaagacatctgattagtgggcaccacttctttctggcacattccaaagatatccactgtatttggccagtaccacaatagattatagaaaatctatgctgaattaccataataggatttttatcattaatactgtccaggtatattgattaaattatttgttaaattctccaaatcattttaaccatatgaaccaagttgacaaagagcttaccatctaaaacataaagtacatcagaatctggatttatctgactcaggttaatgaaaagagtgataaaccacaccctaaactcttgtctttgaaagaagatatagcctgttaccatcgcagaatggacaagtactctcgagaaatcttcatgtacactggccgacttgtttgcctgcattgcttcctacccaatggccatgccacgtgttcatgcatcaaggaagagaaaacttaagaacacagatttgggaaggatgcaaaagtgagagaacaggtgtggacgtgaggacacggggaataaatgagaaagaatgtatcctaagaggacgtattgtgtggtcagagctacaagtctgggtgtttcttctcatcaggcatcattgagaataagcctccttggtcacctgctcatcctgtgtctatccattcccccaccaccccaccctgtccctttcaaatctcctggagggggagctgcacgcatggacagggtggggcaagggagaggctggagctgtctcagcttcgttttgcttaatcaagcctcctttgactatgcttgcccagttgcatgtgcagtggtattcagacctgctcagcaggtggatgagtctgatcttagtattcaatcaaaaactacatttttgttcttttgactcttcttcactgcacaggggtaaaaagtgtggagtctatcagtcagctgttagacagcaaccattttagatggatccgtaatagccaatcaagagatgacaatctccctttaaaaactgacaggtacaaaaataagacctgaataattcatggagagaaggtggatagccttgggttagctgattgctgatgcaccctattccgtgctgtgctcttggcttcaccttctgatgtggcatccacattattttcccagggctgctgcaacaaagtactgcaaaccgggtggtttaaatgatagcagggtattcttttccatttctggaggccagcagtattattggcaggtccgtacctactccaatgcctcaagggaagatcttcccttctctctcccagcttctggtaggcctcaatgaccctggattatggcagcgtaattccaatctccacctctatcttcacatggccatgttctctctgtgtttaagttttccctcttcttacaaaaacaccagtcatgttggattaagggcccatcctactccaatacaacttcatcttaactacttatatcttcaatgaccctatttccaaataaggtcacattctgagccactggcgcattagagcttcaatatcatttgaggggacacaattgaatctattataacatctcaaagcagctcattccttgcctacctcaggtagcaacaagcttaaaataaaagaaagaaaactgtatctatggttctttgcaagtgtagggagtggagggagaccttctcactatggaaaaatatttcaaggtatataacatttcatattggatgatgcagaccgcatgaaatcattgtgctccttaaacaatccctgaaggtccaaccataccagcaaatgctgcaatataaataatattcacaaagacaggtgagagctattgccttaccaggggctggactcatggctgttagaatgagcagcaatgagtattctattcactcactttggctttaaataagaagccaattttacgcttaaaaatcgctgagtgcataaacacaaacatatagaaatctggagggaggctaaattttacacagtctacccacctgctgtttgaaataagagtgctatagttaatgtaaattacgtgcaaagaatgcagattgagaagattagagaaccatcaacttagtttgatcaaatgatacaatgtgcttgaaagtaatttaatacaaccatagagcatttcaatgtttctttctttggaaggggactttttaaaattttatcagtttcatactatgatttatccttctctccagggttgttcatactgtggagtttttctacaggttagcgtaagcttgagcagtgtcagtgacaggatgtctccccactggtgcatgatgatttctcctacagtgtcccacatagcatcaggtatgttcactcaatacatacttgctcactgcaaatatttagagaagtgtattaccacattgctgttatcggaaatttctcgttgcaaaaattagaagattgctaactacaaaaatctcattttgagtatggtatgttgacacaatttgcacagactaggcattagaatgtgactctgggtcatctcacacgccaggaagtttggctagccccttctttcttcccagagagaaagcacctctccaagggggaagcagatgtgaaaaagagcatggagttcgggctgtgggaaccacgccggtgaaatacccacctgaggctgagtcttcataaggtagttgccttgaccagtcttttcaaaagtcatttcttatttccttcattatctccatggttattctacatatcctcgtctggcatccaacacacatcttaaatctcatattcaaatattgggtaaatgagaggaattcctttattttaatcctcagtacttcctgaacatgcaaacctattagtactataaaaattaatgcctataagtgatatttatgtacaggtattaagaataataatcatgtattattctagtgtgggttaaagataaacagtgtttgataaatatttggaaaaatctaagagcaataaaacaagcctcaaatagtcagatcagaggttcatctataggccacactcttcctaaaatgatatgtattttttaaatagttataggatgagagtggattagaaaatggtactcctgtaaagcatatattttcaacgatttcctaagaaactaaccaacacgacgtagaaagtaataatcacatgaatttattgtaagtatccttcgaggtcagaaagaagggtagaacacaagttcttgtaacactggaattggaattccaggatggggaatgtgttatgtatctcagacgcagaagggaaagaagccaccacgtacagaacggtgaagcctctgggtctactcccaaacacgagcatttcccccaggtcctgccaagctctgcaagatgctattgaagagatgcttcccataaaggaccaaagagcagtagtacagtgaatataacctcagaagcaatgtccacaactcagtgaaatttttcaaagcatgacacagcttggccagagctccttaggaagccacaaggtcaactgttaatcatgaaaaaaattttaacacattcaaaagatataataaaatttacaattcaacccccaaatcaagtactaaaaagatcaatgagctgatacacatgtacagaattattagtgcatgttagatatcaggcaaattttgcttccttgacatcaagtgtaagcccatatttaatgcacgcagctccaaaggctggttccctaatatcggctccaaattgagaccacaaagtcttcttggatgaaagatttagaatgccctcaaatctaaagagtgcagacttaaaggtatactgccaaagaaaggtaatgatttctcagtctctcccacttcaaagccatacccaaaggctctggcaccttccccttcatcatccaggaatctccagatccacgtgcatgacctctgatgcggagcagcactcaatccataacagctccacgaacagggaatacatggatgagtcttcattaagatttaaacatgaaaagacatgttcccagcccttttgtgagcttgtgctttggaggagaaaatacaacgaaaattctagaaagccactttactaaatgtatatgtttttataggcatatttttttaaaatcaaggtaataggaaatccatattatcattttataaaactttaacttacatttttttctgactacaagtataggcacagtgtgaaaaatctgaaaaataaaaactagaaagaataaaatataaatcccacataattccattaccaaggatgaacagctgaacaccagagctgaccattattaacatgtttgcatatatccgtctatgcttttttctacatatatatagtatttagataattgagattaaactgttatttaaatagctttccattcagcttattttatttgatccttttatgagattcatgtgctcaatgaatattgtatgaatgttgctaaattatgagtggctacctgtcatttgaatgctttaatacatcattttaatactgtgtaataatccattggatgggtatataataattggattagcctatctgttcttgagtgtttctaatatttcaccattataattaaaataagtttccaaatagatatttttctgcatttctaattatttctttaatacagttctctcaaggaaagtttctgtggtcaaatctatactttttcttaaagaaagacatcaaactgataaattcatggaatagtcaaggcagttgttgggtggtttaatgcaatgacaatcttgtgggggtctaaatacagcagtgaattcacacttatctacttcacctagaatatgaagatgaggcgagataaagataagaacaatgatctttattgcttactacagtccaggcatttttcatattacttcatttaattcccctaaccctttttattagttgaatgagaggtctgagtttcagcaagattgcataggttgaggaccaaggtcatacaatctaggcttgcctgactcccaatgccacattctttcttccacatcagaccagatggcttttatacagtcaggatgaaaaataatagaatatgaacctgcactcaacaggctgtcagagtctctcaagtctccatacatacacaatgcatctgactgcgttttaaccgcttccagagccctggcagctatgtctgggaatgcagctttttgcttccctgagtcttcaaccaaggcaggtaaaccagaaagaagtggaaatgcaatattgagccacacaaaccctgcacagaagtatttacagaagagtgagaaaattcttcctagcagggccaagctatcttttccctagagggagccttgatcttgggctgaggttttggataatggatgaatatcacctggaagacaggggagagggagattttcaacactgagaactgtagaaccgaaggcataccagttcagacttggatcctttgtgtgtaattggggagtactaagagagattaggatagaaatacagacagtcttagatggcagaggggtttaaaactttaatcccaggatctttactgtatgttaaatatttcccaagggaactctaaggaaaatttataaggaagtaaaggtagaattaggtaatttttacatggttaatttgagtggtcaaacaatgtcgtttgatacaaatatactgtgttcagtcagtgtaattgacgaaaaacattggcaagattgttatgaaaattctaacttcaataagaaatgatagcattgtattttaacttcttcctccctttcctctcttggctggttccaaaaataatttgatgtggtgcagtatttttaacttgagaagagactattagggggcattctttattttattttatttttattttaatgaaagaaaatgaaagtcaaatttaaagacaagaaatttctgccttcaaaggtcaggtctatttttactttccttctgtatttttttttttcttttagatcaaaaatttgagtctctttggtatccagctgtaaaatgacgcatgttttttttcctacctggagactgtaacattttcctatattttaggctaaaagggttgagagcaatttgtaaattcattcttttaggaatactaaaattagttacaattgacttatgaatataatttggagatttgggtgtagattccatagttgccttcgcaaggaatgtatctttgatttctttttttttcttaaatcacaaaacttaaaaaaaaatcagaaatactgagaccttgctattggttttgttttctctttatattcatgaacacaaagaaaatgggcattaaagcaattttataaaaaagaatcactttccatggacaaagtctattaaagattttttagtgttcacagttcattttaaatttattttctatttggccctggagtcctctcagggaatggattggggagaaagacattggcattcacacagtgacagtgtgacctgatcatttatttgccaagccttattaaagcccctgaaatcactccctgccacggccctcacagcccatcagccatcagttcggaatgtcaaatctgattacagtgttctcctgcagcctcttccaagccttcagcaacagaaagctgactttatgcctgtgcctacggaagcgggtcccatggaggctccaactcagggcagctcattttgcttctgaaccgccgacagggttcctaaatcgagatgacatttaccattttatattttaattcactagagagattttgtttacttcctcttccttgctactatgtctcaccaaaagataaattcaaattccaaaatagtatatttagttcacaaaaatatgctaaaataatgtttaaatgccatgcaattgcacaagaaaacttcactgattgtcaaccataacgggtaccagagaaaagggattcttcaccatcacgccaacttctgagaaaatcctaactttaggaattagccaaattcagttagattggatttagggctcgttaatatctactgtaatgggaacggtttcccaacacaaggaggctgttggtttgttgtggaagtttcagctcagtaatggagggtgagcaggtgaagaatatttcagatggggggcaactcacagtacacacgtgcagtgttcctgagctgggtgcccaccaggaacggaacacttaactggaaatggttgtggccactggtctgtgaggaaaatactggagaatgcaggcccctaaaacactgctaccactactactaccgttattacccctactactgccactgctgctactactactactactactaccaccactcctaccacaactactaccactaccaccatctaccacagctactacaactgatgctggcccaactgtcctatagaattaatgtttatagtttcttttgaataaacatagaaattgaccctcccagtcttacaacttgacaaaattacatttgtcttatctaagtccttttcttaggaaactaaccatgagggcctcccagataacatcaaagaactgaaacttcccagatcaccacatctagacagtgaggtaccagaccctcacctatcatgattgcctaactgaccacctgcttcctattgacaaactccttttccttacccttccctaattcctgttttcccacacatggttacattgctttcatcctataaaaaccccaattttaatcaatctgagagatggatttgagactgatcttctatctccttggctgcagcaccagaatagtcttcttcactggcaataatcattgtctcagtgatatagtttgaatctgtgtccctgccaaatctcatgttgagatgtgatcccgtgttggaggtggggcctggtgggaggtgattggatcatgagggtcactccctcatgaagggcttcggccatctccttggtgacgagtgtgctcttgctctgagttcacacgagatcttgtcatttaaaagtgtgtggcaactccctctcactctctcccttgctcctgctttcaccgtgtgacatgcctgttccccctttgccttccaccatgatgagaagcttcctgaggcctcccagaagctgagcagatgcccaatgccatgcttcccgtacagcctacagaactgtgagccaattaaacctcttttctttctaaattacccagtctcaggtatttctttatagcaattcaagaacagcctaaaacactcagtgattggcattcatgtggcgagcagtaggacctagactgaacccctagtgttttggcaacactaccaatactactgttaccactgctgctaccactattactattggcggtactactactaccactattaccactactgctactatcactaatactaccaccactactatgctactactattaccaatactgctaccacccctactatcatcactactaccactaatactaccaccaccactactaccactaccagtacttctactgccactacttttactattattgctataccattattaccaccaccattactactgcaacaattaccaccaccaccactactgccactagttctaccactactctaagagcacccggagcattactccttgtcaacttacacttttgagagtaagcttgtagtttaggaggctgtgctgcacacagtacctcattaaggatgtttggattctgctggctattgctgaaaaaacttacctaaattccctggtcctgggcctgtctacaaactacggaatcttcatgctctgggcacttatacactcttaggggacatgtcactttgattcagacattttaagaagtgacccaatgttaatggttcctcagttattctgagcatcctgaagttcaaggtccccttaaacatgaccttgtcccagatcctaacctacagcccggatcccttttgcagttgactccaaatggttcccaacagaccttgcagttttctcccctgtgctcactcacaccattcatttcctcttcctaaaatgtcaaaatacccccaattccctatcccatgtttaaaataataaataacttgcttgctgtcacacagatacaaaatgattggagctggacttaaaattagcctctagggctctacagtcccaacacccttgctctgtctgctccgctaactttggaattatgcatacacactgaaatctccactgtgaaattagaagtttctttcctttcttttttctttcttttttttttttttttgagatggagtctcactctgccgccaggctggagtgcagtggcatgatctcagttcactgcaacctccacctcctgggttcaagcgattctactgcctcaacctcccaagtagctgggactacaggtgtgtgccaccacacccagctaatttttgtatttttagtagggacgggatctgcccacctctgcctcccaaaatgctgggattacaggtgtcagccaccgcacccagcctaggagtttctttctaagaagaggcaatattgttttctttgtatctcccatgtaagtacttgttgcttgaggaatgaatgattcagccaaattggggtccagaccaggtgcagtcacttacacatgtaatcccagcattttagtaggctaaggcaggcaagtagcttgagcctacaagtttgagaccagcctgagcaacatagccagaccttgactctacaaaaatagaaaacttagctgggtgtgatggcacatgcctgtggtctcagctacttgggaggctgaggcaggaagactgcttgaaactgggaggtcaaggctgcagagagctatgactgtgccactgcacttcagcctgggtgacagaggaagaccctgtctcacaaaacaaaacaaaacaaaacaaaacaaaacaaaacaaaacataggagtccaaagattccatctacaaatagctatttcacattgattttgagagtatgggtggaaaagggtttctatattggaagctgagtcacttctagttcctaaatatctttagagttctttaggaaatccacctacttaaactggagagcctggattgtcaattcctgtgtgcatgctatctgattttataaaagtctttatatttcgctgtgtttcagaaagatatttgagataatatccatcaaaattcagaattctaaacgtatcttctctgcatgtgcctagattggaccaacttcctaaatctctgaggtcaagcatcatattaatttagttactgcctagcaatgtgctcagcaaaaaatgctgccacggtttctgttagaagctgcttattcattcattcattcatttttatttaacaagaatttatataaacttagtagtgacaagtatgccttaagtgcattataaacgttgactcacataaacctcacactgcccttaagaggtacgtaaaataattatatccattcctttttgttttttgtctgatgtagcaagtaaaacaaagtaacaaagcaatgttgctgcttttttctcctgtccctggatttcccagttccagggaacatatttctaaattttacccatatgtggaatggattcttcaacaggatttttaacagaatcctagaggaaaaacagccacagggaatctgtgtttgaagcaggtgtcatggtcagcattccccagactcaacctttctccctgttccgggagcaccttcctcccgtgcagcaggtctcagggcccctttacacttttccaaattattggagaccataaagaggtttcattatgtgatttgtagctatttatatttagtgtggtagaaatcttaaaagattttaaaatatgtatttattttaaaaatgaaatagtaaccccattacattatttaaaaatattttaatgaaaacattgtattttccaaaacaaaaaaatagctagaagagtaatattgtttatattttcataaatctttttaacgtctaccctaatagaatgctcaattctcatatctgcatctgcattcaggctttacagagatatgtagatggaaaataaaggagtgttttaatagtctttgtaagtaattgtgaatattctactgaggtaagttttttttctttctttctttttagacagggtctgggtttcttgcctaggctggaaggcagtggcatgagcacccagctaatttaaaaacttttgttgtagagacaaggtcttgctatgttgcttaggctggttttgaactcctagcctcaagcaatccttctgccttggcctcccaaagctttgggattacaggcatgagccgctgtgcctggccttctggggtaatttcttaaaggttagttggaatggtattttcatactctgttatgttaaaattgattgccctatcttgagctttaaatggatctattactaatgcatgacttttgtaacatcatgcattagtcatttatagttcactgagttatgcagatctttcaaatgttgacaggtttcaatatataacactaaaaaatcatatttgttaatataatcactgatctcatcacaaaagttctttaaatattgggaggctgtcaagtacataatggtggatacagtttttccacaatttgaatttttgtttgaaaaattttaccattgaatcaaatactgttggttattttccttgaagtaacaggatcaccttggttcatactttgagaaaataactgtcatctgtagtccaaattaccatagttttctgtcccttgttccgctaagtaaaagtaacagtaacaggaaaagtaacttttttaaagttctattaagaaaaggattatttcagcttgcagctcaaccactcaaatgcttttcctcaaaataaccacactttatgggaatacatttcctgtttcctcacagaggctattaaaaagtcatatactcaagggttgagataaaataaaactaataattatatggctgcataaaggatattctcaataaaattggatttttttttctgttagtgtgtagcagtgaagaatatagtacactatttacacaaaacaagtataattggatcccgcagccttgacacctgctgagacaccagcaattttatccaccattgcagatgtcaaaacaacaaagaaagtgaatgatatctcaatattatcttgaaagtagttttgaccttgcaaatccctaaagggtcttggagaccatcaagcgtgcagggaccactccttgaggactgttgcactttggcattgtgatttaaaatgtgctgcagatgggataatcatatgttacaaaggatataaggagagtagacagggatggtattcttacagccatgttcccaccagggtcaagagaacagcacaaagcccagcccaagccagggccttccaaaggggccccatgttcccctctggaggctgctgacctggagacctgccatgggcccgtcttgccagctctccttcctctttctccagaagtcggcccagccttgctagctatattttacacccaactgagcagagcaacactggacaataatcaaatgtttcccccttttaagttccccgtgtggttgacagggaacatttatgatttctaaatggtcaagtaaaatttattcttattattcttattccttttttttttttttttttttttttttttgagacagagtctcgctctgtcgcccgggctggagtacagtggtgccacctcggctcactgcaagctccgcctcctgggttcacgtcattctcctgcctcagcctcccgagtagctgggactacagactacaggcgcccgccaccacgcccggctaatttttttttgtatttttagtagagacggggtttcactgtgttagccaggatggtctcagtctcctgacctcgtgatctgcccgtctcagcctcccaaagtggtgggattacaggctcgagccaccacgcccggctaaaatatattatttttaagacaaatggtattagattcctaagaagaagctaagctaagagtttttacctctcagatcattagaacaagtatctgcctagggaaaaagtaaagttctagagatcttaaatgtgaaattatttctaaatggagaaataatgattttttccacggggagtaaactatctatatatttccaagtgatactgcttttctttacctaaagttaggcagactgtggctccttgtagataaacaggattaaaaaaaatggcacttaactcaaaattgacattgtcttttttatttgtttttttttttttaatttattgagaggaagatttaacaacaatttcttgaaggaaaaattcaattgattctgagatacattttaattttaggtttaggaagtcaggttctcattatactaaccattttttgacctttcaaaatacaaagttttaaggcttaattttaatgacatatcaaaactcagagtaaggcaatagctatcaataaattatttctttgtattacttaagagagacaagtacaggaaaaaatgaattaacacaattgagaaaatttggaagcaagattatacccccccaccccataattcatagtaattccctattctggctcatttaactatttcccaatatccttcactagacactgaaagcaggcacttccaataacatgccaaccttgtatcatttctatcaagcaccaaagctgacatcatgtgtgcttaacacgctcaatgatgtggaatgattagaaaggacataattattaaaagcatcactatatatttccagtgatcccttgaaatattaaaaaggaaaaggtatcaatgaactagcatactttaatggagaatgtacattttaaaagaacaattttttaatgtccaggtgattagtaaatctttttttttttttttgagacaaggtctcactctgtcacccaggctggagtgcagtgatgcaatctcagctcattgcaacctctgcctcctgggctcaagtgatcctcccacctcagtatcccatgtagctgggactacagagtaaatctattttacaaagaataaattaaagacaatgcccagtggaattttctttggaaaccttaaaatcagacttgtggtttaacaaactatgccttatacagccgatttcttacatgggtggtttggcaggctaatcattgtcatcaacacacatgcttacatacatgtatgcaagcatgcatgtgcacacacacacacacacacacacacacacacacaatacacatgcccttctctctgtagagccataaatttcaccatgaggctaccaatgacaaaatcacaaaagaagatagttgagcctaaaatgtgatagaaggccctagacttgaatggctgatgaggacattatgctcattaataaagcttgagtattgaatgtgcctgtgacaagcatacagcagttaagttttaagtgttcagaacatttgatgaagaaaatatcttagaaaataatatgaaaatcaggcatgtctgtttccaaatcattcatcatcatcatgatcaccatcatggctacaacttactgaactacctgttcagcattgtgccaagaaactgacatagattatctatgttaattccctttttaacataaatgagaaagccctgagatggactgctgtgtcccttgctgactctcttatttctctcttatttcagacctatagcttacacttttcctgtcttctgtgaacacaagttcatgatactgcatttaacaattgcctcaataaaggttaacttcaaagggattcatctatggtacaaacaaaatgctgctacgaggcactttacatttgcaaaatgttctggaaatgtacataaatagcaaagtgaaacagttaagatactgtttcagattctgtgaaccaagaggcggttggagatctcttagatcaaagattttagaggaattttggacaattttgcaagtgatttcctaagatccagtctcttgactagttataaacaattgtgtgttcactgggcctcttgagggcagaagagcaaacattaagcacaaggctaaaagggtttccttggaaacctggtgtttctttaatacagcacaagtcccttaacacgtcacagattttccaggctcctcctgtgtgtctctgaaaaacctgctctttgaattgcacttaaataaacacagggaataattccacttttagatatcctctccggaaagttctatcattgccaacactccatttaacacatagggcttgtcatacaccaggctccaggccaggggttggatatagaatagtgagtggaggaaggcgtggtccctccttgactggagctcactgtgctgtcatcctctaggaaagtctcctcagtttgcactcctggcactgtttgcttcaaattcatttccattttgattcaatggatggatcatctttcctaaaatgactgatattcatgaggtcagcaggcacacccagtaacagacctaggcaatagattctaggatctcagagacatatgaaataatttagtgtggttacagcaaggcttttaatttgcttcagtacaaaatatgtattattcaagttgagctattttggtttttcaactgggcagctggctcccgtataacagaagccatgaagtatgggagatgcaaaggtgaatgggacatagcccatggcccccaggaactgagaatctagtggcgtatattgtctagtaaaaataataattttcatactgagtgatgcttatgttctgaaagcactgagcagaggtagaccctgggaaaatgtaacagggtctttcatgcattaaactgggatcagagcagccatcttaccatattatccctctgagaccttgtgtatataatatctatgcatgcacttaggagttgagcaatttatcaagacctagcattatatccactggtgcaattttgggggtaagcattagtgatatatgctaaaagtggtccccagtagaaaagccacatggcattggtctgggcaaataatttttgtgtatttgacccgaaaagcacaggcaataaagggaacatagtgaaatggatgatatcaaactaaaaagcttctgcacagcaaaggaaataaccaacagcatgaagagacaacctacaaaatgaaaggaaatatttgcaaatcatatatctgataatatccaaaatacataagagactcaatacaataacaagaaagcaaataatctaattaaaaaatggggactggacttgaatacttgttttataaaagatgatatatagccgggcacagtggctcatgcctgtaatcccagcattttgaaaggccaaggcaggtggatcacttgaggtcaggagttcaagaccagcctggctaacacagcgaaaccccgtctctactaaaaatacaaaatttagctgggtgtggtggcgtgcacctgtaatcccagttactcaagagggcaaggcatgagaatcgcttgatcctgggagggagcagttgcagcgagccgagattgcaccactgcactccagcctgtgcaacagagtgagactctgtctcaacaacaacaaagaaagatgatatataaatggccaaggggtatatgataaaatgctcaacattgctgatcatcagggaagtgcaatttaaaaccgcaataacgtatcacctcatacctgttataatgactattttcaataagatgaaagaaaacaagagttggtgagaatgtagagaaaagggaacccctatgaactgttggtggagaacataagctaggacagtcactatggaaaatggtatggaagctcctcaaaaaactaaaaatagaactaccatatgatccagcagtcccactagttggtatttatccaaaggaaatgatatcaatatttgaagagacagctacactcccatattcactgcagcattattcacaatagccaagatacagaatcaacctgtgtccaccaaagcattaatgaataaagaaaatatgtataaaccatgaaatacaactcagccttaaaaaagcaatgaaatcgtgccatttgaaacaacatggataaacctgaaggacattacgctaagtgaaacaagccaggcacggaaagacaaataccacatgatctcactcatatgtaaaacgtttttgtttgtttgtttgtttttgagacagggtctggctatgtcacccaggctggagtgcagtggcacaatctcggctcactgcaacctccacctctcaggttcaagtgattctcccacctcagcctcccaggtagatgagactataggtgtgtgccaccatacatgctaatttttgtgttttttgttcttcttcttgttgttgttaaattttagtagagacagggtttcaccgtgttggccaggctggtctggaactcctgacctcgagtgatccacctgcctcgacctcccagaattctgggattacatatgtgagccaccgcacccagcctcataggtagaatctaaaaacttgaactcataaaagcagagagtagaatggtggttacctggggctgacaggtggagggattggagagatacgagctaaagaatataaactttcagttaaacaggtggaataaattcaagaaatatattgtacaacatagcaactatagttaatagcaatgtattgtatacctgaaaatcattataagcataggttttaaatgttcacaccacaaaaaatgagtctgcagtaatatatattttaattagctttatctaatttagctcagttagaataaattgtgtacatttccacattgtatatatatttcagaacagcatgttgtgcaacataagtatatacaatttttatgtgtccactaaaactaaattttaaaaagagaaggtctccaataaatcagtcctctccatgtcaacaacccatttgtgagacaactttgccttaactcccagattcaagggtagggactcttcctgccccttaaatctgggatggctttgtgacttgctttgaccaatagaaagcaatgcaggtaatgtcctgggagattcaaggtgaccctttggaggtctttcaagcttctaattttgctcaggtggaacccagcagacataagaaggaatccaaacttcctaatataaagagggaggtcacatggaggggagaccctggaggatgagacactccatataaagacaagggtcatgtggaagagtagcgaggctccagaggtctgcaagcccactcatttgggctgtctcagctgaggttctagacaggtgggaggccacttttgattcttcagacccagtccaggtgacagcatgtgaagcagggacaagctgccctccagaaccctgctctgcttcctgtcccaaaaacttattaatataagctgtacaatgatgtttatcttgagtaataactttctgggtgatttgttatgcatctcttaataactggttataacccttctgggtgtgaaccagatccagaggaatatcttgatggttccttatctttcaaggagcccatcaaaggaacttagctctttataaggctcgctggctacctggtgggtttacacagcactacagaactgtgttcactgtgttttaacaacagaagatattacccatctttgcctgaaaataggtttgtgttgctacaaggaggcacagaattatctaagccctgggtcatctcggtgcccaacatgaaaacaaagaatatattaaataaagaatgaagtacactaagcctaaataattcagggttagcattgacaattttcattgatgacgtggatgatgagaaagaaagaatggttactaagttggaaggtctgtgatagggtggggggacaggacactgaaaagctggaatttaaggtaacttattaaaatagattatcattagaatgggaaaccatacattctggaaatgttgagctttaagggcttgaaaggctattgacaaacaatgtgaagggacatgctggttatgagacatttgctggaaattgccctacgagatcatctgggcatcacattcagtttggggaacacatttagtgaggagcattgacaacctgaaaattgaatatcttttatttctgacacagcaacagacattcatcagtcgtaagttggcattggttcttgtaggtttcttctatcctaagatttagttacatcatttatggatattcagtaggctttgtttttgtctgttgatgtgccctccattttccttccccgagcccactcattcctacaggagggatgatgcagtacccctgtctgacacacagctggagtgacgtgttcactcacatgtgcagtgcagtcactgtgtgccccatgatgccagtcataattttaaatgacataactagagttcgtaggctagtgtgattccgataaatgagacatttattctctaataggtagcaatctccaaatagtccatttttagtatgttatgaatggaactagaatattatcatctgacctatccaggtgtttaggtaatgtgtggttatctttttctctgagaaatcactaaatatttatttggataacaattatagttcaatattaatgcttacaaagaaagaaaaccattaagcctaaagaataatttaaatacctaagggtgtattttcaaaactgctcccaaatacatagtcataaaaactgtacagtaaatactggcaatacctttagcttctgagtattgagagctatggcattaaaaagttccattagaatgtaatttgtatttttaaatgttacattacactataatcacttccacattcagccttgattaagaaagtccctattttcccttttatcttatgcaacttgagtcatggtcaaaatatatgaaatagtgatttataaatttggaaaacatgcagggaagcctgaaataaggaaagcgaacaaagtgaaatctctgcttttccagagatgacccaaccagcctgatggtctcttctctgagttgagagcacagtttcaacgctgaagaggccacagagctagaatgtaggaaaaagtactagaggaatcctagtgagaggtggacagatcctgagttttacagagggcccacccctgtcttttattgagttattctgataatgcatgtgggaagattagccaaggctacggcaagaacaagaatcactggagctcatacagaggtgggaatagtttgtatccctgcaagtcagtgaaagtatgtctgaatatttgagaaatcaagtagaaaccacagaattgtattaatattaccttagtaagggagccaatcagttctagactggaaccatgcaaacaagaactgtgcaaacaaggcttaaagcaaggcttgatggaatcatattgaggccaagtaactcaactgcatcccagtaaactgtccaacaatattgaaagaaaactaaaaaatccagcacccaaaacataaaattcaaaatggctgacatccactaaacaattacaaaacatgtctaaagcagaaatatgtatatattatataaagcaaaattatatatatggagaaaaataaatccattttaacagtccaaaaaataaagaaatgaaacagatgataaaattaacaggcaaggaaattaaaacacggatcataaatatgtgccattttcaagaaggcagaaaaaggatagtataaatggaaatagaatataaaaattaaacccaagtaagactttagaagataagaaatttaatatctgaaatgaaaaattatcattggttgggattaataggaagttgggcaatgcagaagaaatcatctgtgaactcataaacaacaatagaaactacacaaaatgaaatacggatagaaaaagaaccagataaaaatgaacaaagcatcaatgacttgaagtgtaatatcaagcagtatagaatatgtgcaattagagacttaggggaggcagagttaggactcctatcagaggaaagaagagatagaacagaaaaaatatttgaagggagtattgaaataaatagttccaaagttgatgaaactataaagccacagatgcaataagtaccgttaatattaagccaaggacatatgaagaaaacaacaccgagatgcatcattatcaaactgctgaaagccagtcatgaagaaaaaaatatctaaaggggccagggttaaattacgaacaaatgaagacaagaaagacaagattttgccatgcaaaccagagacaatggggtgacacttgtaaagttttcaaagaaaaactgttgatatagaattctctatacagtacaaaaaaaaaaaattcaaaaaagtaagtaaagttgagtcttgctaaaactaaccaaagtagaaagaagtcattgcccacagacctgcactaaactgctcacaggagcctttctggcagaaagaaaagaacatcagaaaaaattcaaccgatgtaaacaagtgaggagcatgagagtcagaaaatatgtggttaaatgtaacaccttttattatcagttttaaaatatctttaaaagataattaaccatttaaaagataattaaccatattttgtgaagtttacatcatatgtagaaataaaatacacacaaaaatagtagcaagtctagcaggggagtattggaaatacactgtaataagattcaacaatatatgtgaccagactcaatattacttgaagatagacagtaattatatacacacacacacacacacacacacacacacacacacacacacacacactgaattgtaggggaaaacaaacaagcaaacaataacaacaaaagaggggcagaataagccacgaatggagacaaaataatgttttatacaattaatacaatgaaatatggacttaatccaaaagaaggcaagaaagggggaaagatagaacaaaggatagataggataagcagaaaacaaatagcaagactgaaacccaacattgtcaataatcacactgaattttgatactgcaagtatttcaactaaaaagcaaatattatcagattgtataaaatgcaagacctaatcatatgctgtgtaaaagaaacatactttaagttaagtcatagaaaggttaaagcaaaaagatataaaaaataaggcaaacaaaaaatctcacataaacactactcaacataagttataatagctaaaaccattgatgtgaaatagatatcaaagtgataaacagaaagactgaagaagtgaaaatgagagaagacacacattaccaatataagtaatgaaatacgagatgccactgaagatcttccagatattagaataataagagaataatatgggcaattctacacatacaaattaaacaccttagactagtttctcataaaaccacaaactaccaatactcactaatatggtttggctctgtgtccccacccaaatctcatcttgtagctcccataattcccatgtgttgtgggaaggacctggtgggagttgtttgggttatggagttgggtctttcgctttcctgttcttgtggtagtgaataagtctcacaagatctgatggtttgataaggggaaacccgtttcatttggcattcattctctctttgcctgctgccatccatctaagatgtgacttgctcttccttgcctctgccatgattttgaggctcccccagccatgtggaactgtaggtccagttaaacctcttgcttttgtaaattgcccagtcttgggtatgtctttatcagcggcatgaaaatggacgaataccgtaaattggtacagtccagtggggtgctgatgaaaagatacctgaaaatgtggaagtgactttgcaactgggtaacaagaagaggctgggaacagtttggagggctcagaagaagacaggaaaatatgggaaagtttggaactccctagagcctagttgaatggctttaacaaaaatgctgataattatatggacaatgaaacccaggctgaggtggtctcagatggagatgaggaacttgttgggaactggagcaaaggtgactcttgttatgttttaacaaagagactgatggcattttgcccctgccctagagatctgtggaactttgaacttgacagatatgatttagggtatctggtggaaggaatttctaagcagcaaagcattcaagatgtgactagggtgctgttaaaggcattcagttttaaaaggggaacagagcattaaggttgggaaaatttgtaacatcaccatgcgatggaaaagaaaatatattctgaggaaaaatccagtttgctgcagaaatttgaataagtaactaggagccaaatgttaatccccaagacaatggggaaaatgtctccagggcatgtcagagacctctgtagcccctcccatcacagacctgaaggaaaaagtggtttcatgggccaagcccaaggtctctgtgtgcagcctagggccttggggccctgcatctcagctgctccagctgtggctgaaagggaccaacatagagctcaggctgtggcttcagagggtacaagcctcaagtcttggcagcttccacatggtgttgaccctgcgagtgcacagaagtcaagaattgagatttgggaacctccacctagattttaaaacatgtatggaaatgcctggatgcccaggcagaagtttgctgcaggggcagggccctcatggagaacctctgctacggcagtgcagaagggaaatgtggggtcagagtccccacacagagtacctactggggcaccacctagtagagccaaaagaagggggccactgtcctccagaccccagaaaggtagatccactgacaacttgcatcatgcatctggaaaagctgcagacactcaacaccagcccatgaatggagccaggagggaggctataccctgcaaagccacagaggcagagctgcccagaccatgggaacccacctcttgcatcagcatgacccagatgcaagacatggagtcaaaggagatcattttggagctttaagatttgactgccctactggatttgggacttacatggggcctgtagcccctttgtttttgccaatttctcctatttctcttgattcaatgcaatcccaatcatcatcccagcaggatattgacaaactaattataaagtctgcaaggaaattccaaagatacaggatgactgaaacaactttgaataagaacaaagtgaaaggatttagactacttggttttaagactcattatagagttacctaatcaagacagtatattattcacacaaagataaacatagggacctaaggagctgattagattctgaaaacagacccacacagatagagttaattggttttcaacaaatgtgcacaggtaattcaatggagaaagaaaaaattcaaaaagtagtgctggaatatgtgaacatacataggggaaaaaaaactaagaaatctgtatggccaaaatggacctcaattattgcttcaaaccatatacagaacttaacttgaagtagctcatagacctaaatgtaagagctgaaactgtaatatttctggaagaaaacatttaagaaaacggaagtgaccttaggctaagcaaagatgttttatatgggacaaaaataatttgagctataaaagaaaaaatatttataaaacaagttacatcacagctgaaaaccattgctcttccaaaaatacgtttaagaaaataaaaagtccaactgcagattaagagaaaatatttacaaaacatatatatgataagggaccggtatctagcacatataagagttcttagaactcgactataagaaaacaaaagtcttctttgccatttacaatgtgcaaaatatttgaacagatacttagtgaaaggagatatatgaacagtcaattagcatattttaaatgtttaatatcattttcagggaaatgtaaagtaaaaccacaatgagataccaacgcatacctcctagaatagctaaaattaaaacgtactgtgaagaactgagacaactaaacttttcaactattacttgtgggaatgcaaaatattaatgaataatttacactttttccatgaggtacattttgatattgcttagtccctatttttctctttctttttctttaatgttggccttacaatattaaatgtatttcagatcctaacaatgagtgcaacctgcagtgtgaaatacattgatccagttagctatataggtatgtctcaaaaatcacagattattattatcaaagtgcagagaatatctcgagtgagtcattacctgccgacatgaacctgcctaaggcaacaaagtgttctgataaagcacaaggtaagtcatcaggtctaaaagctaaaaagataatttatcaagacatgggacaaaggaaggaagagctatttattcatctcagctttattcagcatatagatattcacaagtaaccaagagacaattttcttaccctcaataaaatatatccaaagttacatatagcaggatttataatatatgcctacaacattttccaggatcaaagctacagaaagaaggtgtgattccatggaaacaaaggaagaaaaagcctgagaaaaaaagacctggaatttgatttggacgtttttcacatgttaggtactcaatagaatgtatttcttgatatcaaattaaagattatcatcaaacgagcctgattttttctaacaaagctctgtatttatatttaaatgtaggatacatgattttatatagttataaaaaaagaaaagacagatggaatttaactggctcaatttctaggacaaaatagcagtgcaacatggcggaatataaaagggcactgtcatctacagtctctttaacagagcgtgccaaaagttggtggcaccactgttagactgttcaaacaacaaacagagctaatatactgagttatagatgtatttcaaagagaaatgaatatgaggtagacaaactaatgaatgacccaggtctggatggtcactgtgcaagatgctgaggagtgagaccaaatgttttcaaggagcacagttgcttaggagacattgtgataatactggaagagaaatctagaatcctgaaaggacaaaagaactggcctaggcctggacagggaagttgccctggccctggagaaatctgatctgcagaactgcacaaatgcctctatccctctaagggagatctcacaccctggcaaggtaattgctgtgaggcaccatttgcacaggctccccagggggccggtgggaccctcttcgagggtcttctcatccttatacactgcttcccctctctaaactctcccaacccctgccgcaatccctatacacaccttcccccaactctcaggacggcaccatcatgtcatgcatcgctgtcatcattatccatttttattaatgacacataggttttatagctcagattttctatttttaggcagaaaaaaaggttgggaactacaggcacacaggattacttcaaacttccaaaataggcaaaagaggttatttgcaatctagacttcatcagtttttctgtgcaaatatatttttttcaataaaatgacctgcacacttggacatgatgtgaaaagtcctgccttggctggacatgaggggatcccctttttctggattggacacatttgatttaacgctctgcttcatacctgtccttcaaggctctgctcctgcccactcctctatttctttgtggcatttttctgacagcccatcctgcattggtttctcccctttctgaactccgttacccttatttgtactgatcgcttgacccactgtgctcacacacagattatgtcttcatctgtctgcgtgttttatcaataaaggaaggaaaagcctcgtaattatttgtagaaatacccttggttgcactctgtgcctggtaagtttttggtgcttaatggatgcttgttgaagttatctaataaagaaaatggacattcctcttgccatctcttgtgtaaatgttgtcattttgccaaaataagcagacaaagagtttggagacaagaatagtcactgtatttcaagacaaagcaagagcaaaatgaaaaatgacaggtttgtagtttcagcaatttggggaaaaaagtgagctatttgcaaaaaaaaattgtagggattgatataaacttcaattgagttgatagaattattaaactaaaagaaaataaggatcctataataaaaactttaataaaatttcatgaatgatatgtctaggagaggtattatactactctctagtggttggattatagagcaagatgatttcagaattaatttaggatttttttagaaagataaaaacagaaatgtaaataaaatttaaaatctcattctttcatgaacatttcatgccccccaaaaatgctttataatttcaaaattcaagaacatctcatgtaactagctatcattacaggtgaaaatcaagggactctggaacgtgcaatgctccttcaaattttgtcatctgaaaaggtgacattggtctgatttggttgaggcatctgactatatctgtaactctgacgtccatatttgcatttccaatatgacaactcccaactgaataggaaatttcctaaaattttcctttaatagcattgtaaagttgttaaggttgcgtgaacatctatttttatctcatttattttcattttttattgccaatatataatatttcatacagatttaattttattattattatacttaaagttttagggtacatgtgcacaatgtgcaggtttgttacatatgtatacatgtgccatgttggtgtgctgcacccattaactcgtcatttacagatttaattctttttgagcagaaaccatttttcaagacaataaaggtgaagaaataaggtaatctttaaataatcattataaagatcttgcaaattgatggtaaatttctgagtacaatagaaaatacattagaatcaatttcagaaacatgaacacaagttaattgttgtgtctaatgtgtaatattgcatttgatatttgatgaagaaaaatagatatacagagccatgtatatgtccatattagacagtaaataactcatattttatcttattgctatagtatggaatttagctataataaccacccagatatttccggtctggttctagatatataaagcaatttaattcagtttaacttagcaaattataatcgttgtgcttagttaatattaatcacaagaaaaattaaaaaatccctttcacataagtacatcacttgacataatagacatgaagaaaggatcacaataacaaaatacaaaaaaaaagttgtttatacaaattatctcatttatttctaagaaaaatgcctgtccactatcatgatcctcatgtataaacggggaaggtgaggctccaaattatgaagccccttgccctcagtaactttaaggcagcctcaaacctagacctagtgcgtggatacacctgccctttcttctatgcaaaagttcctcaacaaaaggcagattggagaacttccttggaagtaaccattgaagtacgataggggattagaggggtgtaaagaaccttcatgaacatgaagccagagtatcagttgtgttcggcaggagatttcaatgccatccattgaaagcattgagattcagtgttatccattgtgtttggcaggagatttcaatgctcagattctggaaaactgtctgggtgggaagacaggaaagtaaggctggccagaggaaaggattcagtgaacgtcctctaaactttgacatggtatctgagcaaaaaatcttctaagagtttaagttttgaccaaccaataagttttaattgaaattcaagttaaagatgtggatgctgaaaaaaactatgatatctgtaaatccaattcatatagttctgcagctgggaacgggagaattttgtaatattccaaggagggtgtttaggttatgtgaggtgaagattatggccacaagaacatgggttttactggcaatcaaagcaagccttcttttgctcaggattgccggtactgaagggcaaaagtaagattgtttagcaaacagtaaaaattagtgttttagaaaacatctaattaattatcacaacataaaccaaaaaggaattttgtatgtgaaactagaacaatctgctaaaatgaggggataggctaggatgtgaataaactggatagatatgaaaaaacatgataaatgaattaaggactgaaaacagtagaataatgcataaaattgaattagtggggtaaaatacaaatacaaactataaatgtttcacaaaaatttagagaaaaaaaacccctgatagaacaatttaaaaacctatgaactggacatgaatattcaacctatttttttccaaaaattccaggaattcaggacacagaaaaggaaataattaaagaaaaaaatatatatctattttgagatggagtctcgctttgtcacccaggctggagtgcagtggtgcgatctcggcccactgcaaactctgcctcccgggttcacgccattctcctgcttcagcctccagagtagctgggactacaggtgcccgccaccatacccggctagcttttttttttttttttgtagttttagtagagatggggtttcactgtgttagccaggatggtctccatctcctgacctcataatccgcctgcctcagcctcccaaagtgctgggattacaggcgtgagccaccacacccagcccagaaaatattttttaaatgtattcaagagttcataaaatcctgtgttttcagatagaaaaattcatgaagtatccgaaatattatttaaaagagaaataattctgaaacatatatcaaagaattttgaaatataggggtaaagaaagttttctaactgtgcaggctggtaaaacaggtaatttatacatgaaaacactgggtttcatcatccaaggtcaatggaacagaatatgcacctctctgagcaaacttctatacccagccatcttatctttcatatatgagggcaaagaaagagattcacccagattcaaggtctcaccagctataccactcacatataatttctgggaaaaattactcagatacatcttctagcctatcaaaagaactcaagaatgtattgcataacttaatctcagctaaacataaattatgtcaaaagatatgatatggtcatgaaacctaaaatcaattctatcattgtcagcatcatcatcaccatgtataaagtctcacattattgttattggaacaaggaactgactagaaagaataaaaaattaaaattatataaaattacccactttatacccaagaaacccatagatacttttttattcttggcttttacacctataaaaaagtttggataagtatatataaaatttaagagtaatcattagaacaaatactgaaggaatgcttttgagtcattagagaaaaagtggttatgaaaatgacatattaagggactgataatataataaaacaaaaaaattaggcacaaagcaaaatacagtaacaggataccaattgtgatagctttgtagctcaagaaaactcatattttcaagaatattgaataatttgatgagataatcacaatgtaacactggtaaaataagcccggtgagaaattatatataaacaatgccaattttcatttttaaagtaagtctatagatatatgtgaaagactaaaaggaaacagtttgacatgaatctgcgcttgagtgtatgactcaagatctatgacttgggttctggatttcgtttatcttttctttatccgtatcaaaagcctctacatttgctaaaatcagaatgcctggtatttataattcagaaaatcagcttttgttttcaaaaggtggaagccactgaaatcctgaggaaaactgagggaatcaagtcaaactttatggagcaagcaggaaggtcaggattcaggagagttggtttgaaccaagtatctatggtgttatgggttgaattctgtttccccaaaatttgtatgttcatgtcctaccaccagtatctcagaatgtgaacttatttgagaatactgtccttgcagatgaaattagctgaatgaggtcattagagtgagcactaatccaatatgcctggtatctttatacaaagggggaatttggacacaaacggacatacaagaatgccatgtgaccctgaaggcagatatcagatgatgtttctacaagccaacaaaatgccaaagattaccagcaaacgaccagaagctacgatcaaggaatggaacagattctctctcagagtcctcagaaggaagaaccctgctgataccttgatctcagacttccagcctccaaaactgggagatgatgcatttctttcgctgtaagccactcactgtgtgtgctttgtgatggcagacccagcatactaaactaatattaaactaatatagaagcttaataaggagagtgcctgggagcaacagcctcaggcatagtcttaaaagtgtcaccttctcacctatatttaccataatatgttaacctgacaattgtttcagccatgaagaaagacagaggaattgatgtgtgttcaagacttgagagccatggagaggagctggtatcaccactgcctgcagctcaggcccatcactgcatccttcactccaccattcctcacctggattcacctcacccctgacgttagaacctgaacacgcctccgaaactggtgagacagaggagagaaactaagcatacagtacctgtcctgtcttgtcaaagggaagcctgaccttcggtaagcatagtcataggcaaggggaacccagcctgctcagaaagtgctgcatgagttcattctgcaaacttcagggcacttcttagcatgctcctttttgaagaattacatttgtgcttgtgggattggtgtgggacactaggctagaaaaatttggatatcaaatacatgtgctctcataggagctgccagcgctgtgtgttttgaggtgtatgttgaaaaataaccctgtcccagagcctttcttttactgcctctcacagtctttgaatttccgccatcaaggggcatatctttggctctcaggagagataaacaacagtattatcaatcaccattttagcagaattaacacctgagaggcggaaaccaaaatggacaaaggaaacaaaaagtacttggattttaagacaaatatctccatgactttctctctgacagtgttgaaacaaatagctccttgggagaggacatttcttttcccaggtgccctgcaggggagggtgcttagaagaggtctacagagccaaccttgagaaatgtcctatagggctgtggtttccctgcctaagacaaactgagaatgaggaggctctgagcatgtaatgcatatggaggagacagaaaaggctcttttaaactgaatgcctcattgacacaactgctatctttctataaacttagacaagggatggcaattatgagcatatccactgatgcatgtcctgctcatgcccatggcagacattgctaatcaattactacactcttttctagtgagcacagataagacttcagaatccttctcagttctgcattccaggcagtcactaccagtcagatggaactgacattcaaaatgtaatttatttccagtcttggccttcgagggcatataccctaaaagtctaaaaggttcgttgacatatttggatattttaattttatgtgcctggatagaaagctttgttttaaaagttggtggccgagcacagtggctcactcctataaccccagcactgtgggaggcggaggtgagcagatcacttgaggtcaggagtttgagaccaaattggccaacatagtgaaactccatctctactaaaaaaaaatatatatatacaaaaattagccggtcatggtggtgcatgcctataattccagctactcaggaggctgaggcaggagaattgcttgaattcaggaggcggaggttgcagtgagccaagatcgcgccactgccctccagcctgggtgatagagtgagactccgtctcaataacaacaacaaaaaagttgacatgtaaagtctattttttaaaaaatgtatatgttgtttttctggattttcaataacaacttgcaaaaaccacatttttaaacttcctccatatgaggcagccacaaaaccaaaatctctttgctgcaggtttttccaagaagtaaaggtcttgcagaaaatcatacattcaaatattccatcaatgtaataggtaatcaacctcaataaaatgttcgtctatccacatagaatactattgcctaataaggtcttttactaagtaattataacgacacaattttatcagtaaaggttaagtatctttatctgagcagaatccaatgaaattagtcctgatgtaataagtaccatttgtcactattagagctagaggggttgacaggcttggatgtctccctggcaacccgagtgttccatttcttttttctgtaaccttagacactaacaaggcataaaagtccagagggcatagaaggtatcgcctgggtaatttatgtaccctcttctgactttgccaggcagtggcatatgcgagcatctagaagcattttaacagcaaatatattcattcccaaaattttgagtcacgatgaatattttgaacagaagtattgtattaatgtaggtaggttttcattaacaaggacagttactaatttttaactgactcattatccacaacgagagagagagagattgagaacatgtatgtaaacggtgttacaacttcctaaacacactgcgcatgctcacctcccaaggggaaggagggcactgcgcatgcgggaagctcgtcctaagcgaagagtcatgggaaaggggtgcaagacacctgaagtgggccagcctacaaagtcctaggatcaaggttaaagattgcacttgtccttcaagttgcctgcttcagtctcttccaagtgtacttccctttctttcctgttctaaagctgtctaaaataaacttccactcctgctctgaaacttgcctcagtctctttttgtgccttataccccttggtcgaattctttcctctgaggaggcaagaattggtgttgctatagagccatatggattcgctgccggtaactcagataccatccaccagtaacacatgtgggccatgatcagtgatgtaacaaaattaattatgaatggcatttcatagatgttcctgctatcagtcttaatgggcagaaatccaagagcggaggctgtgaggggtgtggggaagagggagatgctggataaacatttagagaaatattacaaacaaaattttatatttcctcactttcctattatcctttctctttttatatatagctaatatcggttttccactttaataaataagctaatataaaaatatgatttctaaaaacaggaaggtaaaatttgaattgtcctatttttaaattttgcaaacatcaataccaagatttggaacactgttaatttgcagatagcctagcagcatgacgtaccttttaaaacagatttcttttattttctaatttagaagtcatgggataaattgcgtccccccaaaattcatggcagacccctaacctgcagtatctcaaaacatggctttacttggaaataaggtctttatagtgataatcaaatttaaatgaggccattaggatgggtgccagttcaatataagtggtgtccttatagaatggagaaatatggagacagacactgacacccatagagggaacatgaggtaaaaacactggaagaagccagccgtgtgactggcgtgatgtctataatacaaaccaacaagagcaaggcttgccagccagcgccaggtgccgcaggaggtgagcaaggacctctccagaactgtcagggagaacatggccctgcagacacctgaattttggaggtgtaagctccagaactgtgagagaatcagcttctattgtggtcatatgttatggaatccccaggaagctcacacaatttacttcagattaaagataaaaaatctatttccagaatataatcaaaggttcaacaacgatatgcctgaggacatgacattctgggaatagattatattctggaaatagctttcttatctttaatctaaataagctgtgtgagtttcctgggggtttccacaaaaaattatcacaacaggccagtcgcacatgtaatcccagcactttgggaggacaaggtgggcagatcacttaagttcaggagtttgagaccagcttggccaacatggtgaatctcctcatctctattaaaaatacaaaaaaattagctgggcatggggatgggtgcctgtaatcccagctattctggaggctgaggcacaaggattgcttgaacctggggggtggaggttgcagagagccaagattgcaccactgcactctctgtgacaagagtgaaactccatctcaaaaaacaaacaaaaattatcacaacagaagtttaatctcttacagttattgaggctacaactccaaaacagaaccaaggtttgggttacataaaggaatgctgggatcaaaaaagataatgatgtagctgagattaaaattctcttcccggccaggcatggtggctcatgcctgtaatcccagcactttgggatgccaaggtgggtggatcacctgaggtcaggagttcaagaccagcctggccaacatggtgaaaccccgtctctactaaaaataacaaaaattatgagtgagaacatgcggtgtttggttgacgagttaacgggtgcagcacaccaacctggcgcatgtatacatatgtaacaaacctgcacgttgtgtacatgtaccttagaacttaaagtataataataaatagataaataagaatttttttacccccccctaaaaaaaaaaacatacaaaaattagctgggcgtggtggcgggtgcctgtaatcccagttgttcaggaggctgatacaggagaatcgcttgaactccagcctgagcaacaaagagcgaaactcggtgtccaaaaaaaaaaaaaaaaaaaaactcttccttgttcatttcataaacttaaaaacaaaaatacagctttttttctgttttagtataattctaaagaatatatttacttccaatcttatagtttctaatccaccttcagcatgtatatacacacacacatgcatgtgtatccataaacatatataaacatacacatgttaactatatatgttatatatgtgaacatgaataaactatgtatatatggatatctatctatatataatatccttttgtagggggcagaataaaggacaatgaagctaaacttttcagtaaatttcactttgcttgctggtcaatcaagagcttctccaaatctcatgtttgattgttaaatttgcacctgtgaacacacatggattggggtcagagggtgtggctggccccatactactccattggtagcactggaagaaaagaccgactctggactgtatccagcaaagccaggcacaattgtcaggggcttgtgccctggggctagctaagcaggaggcagacttcctaaactagcctgactgctgtcacagttaacagaagctgcatagatgggtctgcctacaatggtcacaaatgttgtcactttacaagatccatggacagtttgttggaaaacctgtgctgcttccttttctctccatttgtcctttcattggccattcagtaatttggcgaggtggtctatgggcattttcacgagtggacgttgcctgctgtgggaacagttcacggcatctatgtgtctatactactatgcatctgtgactactttcagaaataggaaatttgtcatctcgttatacattctaaattgttaaaggttcataatgtaaatggcaatattaaagttgtcaaaggccacatttcactatttattttgtttttagatgtcaatgtcataaaagataagtgttctagagagtactatgacatgagagatgaagaaaagtacaagatactttcccagaggcataactcaaagggctggagcctaggaaagaggcccagcaagctttgttgtgtgcttcctaggagcaccagctagtgaccacagcaaacatgacaatgggaatggtgtcatttgggctggggggttggagcagcacacacaggacaatgtccacagtcattctcctcagtcaagcccaaaccgtcatcttggctcacatttgctctttcttcattggtacttggctaacactttgaaaaaaaaatctagtgtgcaagggtactatccctatttgtgggaatacttattacagggggtataataagcagctccctaggtgtcagccccgggacctgatgctgtcagccgtctgagataccagaagcttgagtgttctgattccaggctcaccaagcaaccttctggccacagcactctctgcaatgagccttgaagacagcgagcagggcatacaggagaggggcctaggtggcccagctgactgctgctctggtcatggacctgtctgtcccagctgaccagaccactgtcattggaatggggctgtctgtcctagctgatcactgtcctgggcatgaacccgtgtgtcccagctgatcactgtcctgggcatgaacccgtgtatcccagctgaccatggccctcggcatgaacccatgtgtcccagctgaccatggccctgggcatgggccattcatatactgacaaactcaattgttcaataggttaatgggagctttgttaccatgaaccagaattaccaaaccccctccaatctgggtcagtatcaggatcgtttttcagagtctagaaggctaaggtcagacctcaagtagaagagatttgccaaacacaatgcccacctgcagtcaacattcagaatccctggccttccctctgtgaatgaaacctcagctcccttattgctacccactttgcagcactttatgcaaaatctctacagcacagtaaacacagggaaagagttagggagaggataagctgccccattggctttgtcattggaagaatgctgcagattctcatcctgatgcatcaaaccaaaccagacacaagctagggaggctatgctcacggctgcctgccgcatgtggcctggtgctgctatgtcttcctgtgagctttgattgaagatgtcatccagttgaggtcagttaagtattgtgttctggatgaatatcagcactgaggcagaaagccccatttttttaaagggaatttcccaaatgatactgattaatcagctgaattttgatcctaaattcttccagaccttgacccattatactttgtgctacactgtatcatcttcgctctgggagagctccatctttcttgtctgtcctcacagtccaggtccagtctgatctactatgaaggggaatctgcctttaagtttctgaaatttaggcttggcatgttcaacaccaaagctcatctgtcttaaccctaatattttacctgagatttacttactcttcattctcccaacaaaggcgctggcctcaactgtgtgaccatgagggcaaatactttgtgtgtgtgtgtgtgtgtgtgtgtgtgtgtgtgtgtgtgtgtgtgtgtgtgtgtgatggagttttgctcttggtgtccaggctggagggcaatggtgcaatctcgtctcactgcaacctctgcctcccgggtccaagcaattctcctgcctcagcctccagagtaactgggattacaggcatgcaccaccatgcccagctaatgttgtgttttcagtagagatggggtttctccatgttggtcaggctggtctcgaactcccaacctcaggtaatccacccgcctcagcctccaaaagtgctgggattacaggtgtgagccaccacacactgctgcaaatactattttattatcaattgttgaactgcagttatgagtcttttatagagtctaagacaagcaaaaactaaacgagaaggcagaactatctccaaacaggatatgcaaatttactaattccctctagagcaaatatccatatttagtgtcgtggggctgtgtgtttcagctggccgctgccctgggcataggcatgttgtgtcccagctgaccactgacatgatatcgttctacttcctttatcatacagcgacctaatacacacacacacacacacacacaccatttcatgtgactcctttcatttaggaatataaaatataatgaaagttgcattagtgtatgaaaactttgcattttaggtactttttcaagcatcactgtaaccccttgcagcatggcacttttgacagcccccacatggctactgagtacatactgtataggaggctctgagcttgctaggcaagggagatgaactggcaacaagacataatctttgctctcccatggtgcttaaagttgtatccaaattttcaatgttattatatggcaccaacaaaatataataatgtttttcattgcaaacacaactgcagatttccaattttttgcaaaatgtcttttgcaaaatataattttaaatgttacatttatggactttagagaggcagtattgtatcaagttttttgtgcttttttttttttggagacagagtttcactcttgttgcccaggctggagtacagtggcgtgatctcggctcactgcaacctctgtctcccgagttcaagcaattctcctgcctcagcctcccgagtagctggggttataggcatgcaccaccacgcctggctaattttttgtatttttagtagagatggagtttctccatgttggtcaggctggtctcaaactcctgacctcaggtgatccacctgcctcagcctcccaacgtgctgggattacaggcatgagccaccaagcccagcctgcatcaagttttaaagtgtgaactgtggacccagatagcctgggctcccagctcagggctgccacttgtagtttggaaagttgttaaacgcccttgtacttcaggtccttataatgtcagtagagaattaaatgagttaatacaaacaaacagcacctggcttactgcctggcacacagtaagtactcattaagtgctggctattattaagtactccagaatatgttacttattttacttatttgataaacactttctggattttttctatgctgggcgctattccagatggtgagatgcaaaatataataagacatgacctctttccttaatgcaattttgggtcataggaattaaagttactaatatctccttaaaaatgaccaagaaaagagccttcagagcaactctattaaaagtcattaagaccttgtgtaaaatacaaatgaacaaaaaataatttttcctaatatccagtaatctgaagagtaccctcacacacatagagggggctggtcgctgcttgtcacctcttgctaaaatccagcactctgcacattgcatttgatggagaattaatcttcataccttcactcacagcctagctcagtgctattttaggtacagttttagcaacacaatgttttctacaagttgatgtagagacagctgtgatggttaatactgagtgtcaacttgattggattgaaggatacaaagtattgatcctgggtgtgtctgtgagggtgttgacaaaggagattaacatttgaggcagtgggctgcggaaggcagacccacccttaatttgttgggcacaatctaatcagctgccagcaaatattaagcaggcagaaaaacatgaaaacaaggactggcctagcctctcagcttacatctttctccctggctggatgcttcctgctctcgaacattagactccaagctcttcagttttgggactcgaactggctctccttgctcctcagcttgcagacagcctcttgtgagatcctatgattgtgtaagttaatacgtaataaactcccctatatatatacacacatatctatcctattagttctgtcctctagagaaccccaattaatacaacagtgaagagtggttttcagggccctggctctaccgctggactcctgtctatcttcctcctgtgtagctttactgccggcttcgcctctttgggcctcattgtcacaatctgtaaacagaggttttgggaaagtcaaatgagataccgtgtgcgacgcacttgaggcagaacacacagcacgtgcttcacacatctttaccggcattcttcttctctagctgtacaactagaaggtggtaagggtggaggcagcagtgagagagaagccgctactgagacagctggagagggagaaaaacaactgcaaaatcttacaaatgaaaaccagcaattcgaaaagcaaagcagtctgagaatatggagcatctctatgttatacagaatctctgcgaagataaatagaacaaaaatagttatcctgccacatcttcattatctctcatttaaaagggctgatgttatgcaaagattttcagaaaaacttccatctaaactaattgaaatctcatgtaatggggtgtacaactggcccctgaacaacccaagtttctgcagtttcactgatacacaaattttcttctgcctctgcccctcctgagatgaatccttctcccccttcctcctcctcagcctattcaatatgaagacaatgaggacaaagacctttatgacacctcagcctactcaatgtgaaaacaaggacaaagacctttatgatgatccacttccacctaatgaactactcaatgtgaagacgatgaggacaaagacctttatgactcctcagcctactcaatgtgaagacgatgaagacggagacctttatgactcctcagcctactcaatgtgaagatgatgaagacgaagacctttatgatgatccacttccacctaatgaatagtaagcatatttttttattccttatgattttctgaataatgtgttcatttctcaagattattgtaagaggacagtatctaaaatatataatgcaaaaaatatgtcaatcaactgtttatcagtaaggcttccagtcagcagtaggctactatattgaagttttggggagtaaaatgttatatgcagatttctggctgcctgagcagtcagtaccccaactgctgcatttttctagagtcaaccgtactagtttcttgtggctattgtaatggattgccaccaacttagtggcttaaagcaatagaaactgattctcttataaatgtattcttctggccaggtgtggtggcttatgcctgtagtcccagcactttgggaggccaaggcgggcaggtcacctgaggtcaggagtttgagactagcctggccaacatagtgaaaccccggctctattaaaaaatacaaaaaaattcgctaggcatggtggtgggtgcctgtaatttcagctacttgggaggctgaggcaggagaattgcttgaacccaggaggttgcagtgagccgagatcgtgccattgcacttcagtccgggcaacagcatgagactctgcctcaaaaataataataaaaaataaatatataaataaataaataaatatcttcttcttctgatagtcaaaaggctaaaatcaaggtgttggcaaggctgttttttccagaggcttcagtggagaatctgttccttgcctcttccaccttccagaggctgcggtgtttctcagctcctggccatcactcagatctccacttccttcctcacaccaccacctcccacttcggccctccagcctctgtcttatgaggacccttggggttacctttagatgccactcaaacactctaggatatcctccccacttccaaagatcctcaatttaatcacatctataaagtcctttttcccacgtaaagtaacattcacaggttcctagtgcttcggattcaacatctttggtgaatggggcattattcagcctatcatataggacacagctaattatcttgccctaaaatagatgccccttttcatcaacgaagccagaagatgagctatgaatagatatagtaaaggaaaaaagtagtcagtgcccttcattttgacatgcatcaacttactaaatctcaaagcaattatatggcttaggtgagataatctctgtcatacaggtgaggaaactgaggcccagagggtgaagtcatgtgcccaggttccacggtagctgagctgggtttgcacctggggaagtctgagcctgaaacctactctcttaaccaggttgacccatcgcttctcgtttgttcttctttcccagctgtgaaagccaacatttctgttgtaaccattttctatctgtttcaaattataagcaatttacagatacaaaaaaaatcagtcacatttcttcttcattcattaatatacctgtcaaaatgagccgggcatggtagctcacgcctgtaatcccagcactttgagaggctgaggtgggtgaatcacgaggtcagaagatagagaccatcctggccaacacggtgaaaccctgtctctactaaaaatacaaaaaattagccgggcatggtaggtagtcccagctacgcgggaggctgaggcagaagaattgcttgaactcgggaggtggagactgcagtgagctgagatcatgccactgcactcagcttgggtgacagagtaagactccgtctaaaaaaaaaaaaaaaaaaaaagagcacctgcagcaggcaggcaccagctgcacgggaccaacacagaaagcataacatctgcctgttcatatgggctccttctgctttgactggccccatctccaacccctgcacgggactgcatttttctttgaagatgattttcctataattcaattattaaggaatgaaaacaaaagcttggagagagttggatttgttcacactgttggcggatggcagaggtaggatttatttttttctatctctcttccagtttagggaaatggctagcaagagactgcacaatgtcacctgaagtggatgacatcacttgaaataggtgacatcatctgaggtggatgtcacctgaggtagatgatatcacctgaagtggatgatgtcacctgaggtagatgatgtcacctgagttggatgaggtcacctgagttggatgaggtcacctgaggtgatgacatcatctgaggtagaagatatcacctgagctggttaatgtcacctgaggtagatgatgttacatgaggtaggtgatttcacctgaagtggacgatgtcatctgaagtggataatatcacctgcgttgggcgatgtcacctgaggcagctggagtccacaccacatggtttcacctgggaagggccagtgacttccaaggggcatctagaccgcctttcttcttccaaactgggtatttcattctggccctcgcatggctgcctgtcctaatgcagttccacaactttccttaccagccttgtcatcaccattttccttttaatcatgtttacacacacatgatcacgtggtggcagagcacacttattctcaaacattaatgccacacaaagtccaccaggacaggatacgtttaaccctttcagcttgtacagccagagcaggtgtgaacacacaacatggaggcagagagcagtgtgctcatgccaacacggagacgccaacaacggcgtcaaacatcagcaaatgagaaatcacacatcacctttccagtgtcttagagttaaacaaaaccctttcttgaaaaacagattatttgaatttaggcttagaatcaaatggctgaactcaaactctatctggacgctggcaagaccatgcacactacaggatggtagccactgtaggatggtagctcagcctgggggctggggacacaggctgcagtaattgcttctcataatggtgcattatgctaggaaaacaaggtgagcaattttcctaatcaggccatcaggtggaaataattaaacaaaataatgcagcagcacctcaattataattgcaaaaagcagtcctgatatgccctgtgtataatgaaggaaaataatttttgaatttgtgtaattatttgttattctcaataaacctatattgatcattatcaatacaacatgtgtcacaaaaaaacacccgattagacactaaatccagatattggggagaatgtacaatcactgatatgtacaagacccatttcagctatgaatgattatttcctcacagccttgagaggtagccacaattagccttgtttgttgagtgggacaagtaggaaacgaagaaagaacatggccctaggatgaccttttgagacaggccatcctatcctgaaagacctacattgtccccaacaagtgctctagaaagttttccaataatggaatcgatcagtgatagacaaatggtagggagcggacaagatctctccttaggcaggaggtggcagagattaccccggaatcacccttttccagttctgaagtctggtggctgcggtgtgaggtggcgtggcacaccagtggccttgccccgcagctgccaagcggaatcctcttggcttaaaggaaaatcctgtgagcccgcagctgctcaaagtgcagccttgttgctagatgatttattaaatccttgcattctttcaacttctctaatgtttgtttaatttagttggtattatgcagcaaacaaaacaacaaattttatagttttacatttcagatttaagcctgggatccattctgagtgaatttttgtataatctttatgtcaaaccctggtgacacaagtttacctttataacaaacctgaacatgtacccctgaacctaaaaatgaaagtttaaaaattaataaataatacaaatttaaaaactgtatctaccaaaaaaaaaaaaaagctatgagatttaggtgaaggttcatttctttgcctatgcatatccaattgctcttgtactgttttatggaaacaagactatcatccctcctttgaattgcttttgtacctttgtcaaaaatcagctgagcatatttgtgtgggtctatttctgggttctctattcagtttcactgatctctatgcctatccctttacctatacagacagttcctgtccgatggtttgacttaggatttttgcactttacactggtgcaaaagtgatacccattcaatagaaaccatactttgaattttgatcttttcccaggctagcgatatgtgatatgataccctctcatgatgctgagcagcagcagggtgccacagctcccagtcagccatggaatcaagaaaaacaaccatgagacattcaacacattttacaagacggacttgttagatgattttgcccaactgtaggctaatgtgggcattctgagtgtttgaggtaggctaagtatgatgttcaatatgttaggcatattaaatgcattttcagcttaagatattttcaatttaggatgagtttatcaggacataaccccatcataagtcagggagcatctgtactgtggaatatttttaacatacttttgtgccaattaaattaaagtgtctctgtatcaattgtagtgatgtatttcttcatctaaaaatagttttataattcagaaattacacaaagattaatatggaaaaatttccccctgagatggttagtttacacaaattacacttgaacagtattttcgggtttaagttgccccatcatagtcctctgggggaagaacctagaacttctcaaaacaaggctgagctgaattctctctgaacaggaattcagcagctctggttcatgctggcatctagtggtgtgtgcacatacatttagattaggaaatctggtgcatatttttaacaattaagatagattcttaactctccactgagtttgtctcttattgacccagatgacagaaaacagacaacaggggtctcacctgagacttgtttggcagaacaccagttctgtgggatatgatgaggggtgtcaggaacagctacaaagcttgaaggactcgccaagtgaaactaggccgccctcgttaaaaaatggttaagaatttcaagacgaaaacagcagcgcattaagtcaagcactgggtccttctaagagcacagtcttttgggatgatagagttcctgcatgcatgaagccagcttggaagcctgtttcttgctgaaacaatcaatttatagaatttagattttattacctcagtaccctccagggtgtttaataagttattgtaaattttgggtttctgggaagggcatatactgttttccaaaaggatttggttctgcatgtgagttatggcctctttttgggaaatagtgtgttacacttactgcagatatgccacatacctataatcagatgtggtggctgaaaacacaggaagtagattacatttggctgaaaaggtaggaattcactttcaggattcctgaaaaggatcaaaatcaggaatgtgaaattaaatgattattttgatggatgacctacaggcggctttcttcagaaggggtgtagacaggctctgtgacatgttcactgtttgggtcacattcaggaccattttcaagcaaggggagacttgctgtgggaattgccactctaagaatcacaagggggattcaagaaactaagctcggggctccaccaaggtgtccacagagtcacagaggcaatactactactaataatagtaataacaatagccaagcttcaccaagcaccaaccatgggagaagtatgaagattcccatgagcaattacataatcttagtgaaaaccctgtgagaccagctttatgattatctctattttgcaagggaggcattgaggaacagagaggttaaataacttactcaagttcacagaccttaaaagaagagccagccaggggtggtggctcacacctgtaatccctgcactttgggaggccaagacaggcagatcactcgaggttgggagttcgagaccagcctggcccacatggtgagaccccgtcactactaaaaatacaaaaattagccaggcgtggtggtgggcacctgtaatcccagctactcgggaggctgaggcagagaattactggaacctgggaggcagaggttgcagtgagccgagatcctgccactgcactccaacctgggcaaaaagagtgaaacttagtctcaaaaaaacaaaagaaaaaaagaagaagagccagaactggggcactggcagtcaggcccttgaggccaagctctcagatttggcttgcagcaatgttcatctcatagcctcacaggtctcagtctgaccctatgtcctaccctgtattgaccttgaagctgccttcttgctcgccaccaggtgtatgctgacaccaacacctgattaaaatgaagtttctggcagtagcagcagacccaggaccaggagtctggggacacagcatcgagtctgtattctgccatagactgtgtgaccttgaggatgccacttgtcattgagcttaaaatgaaggagatgagataatttttgagacccttttcaaccctaagatctggtatcctaatttaatgatcacactcaataaaatagagcttgtgatattgtccaaagtaaaacaattctagaatataaactccatagatgcaacgatcatgtgttatgttaatcttggtatcttggaggtctagaacagttcctgatatacagtaggctttcaaacaatgattgggttgatgaatgaatgaatgagtggtaagtgaaggagttaaataaatgagaaagtgcaataatccgacataaagcaaatgaacattatacacttttgtaagcctcacaaaccatggcaccaaattgaatcttgcaatcatagcacggccttggccaacctcaaggtccaaggtctcatcaacatttagttgttggacctatcattgctggtaataggcacacagtgtctctgagtaaaagctaccatgttggcccgagaaaaagctttcttttgatgctaacaacataaggaatgaggactgattgagataatttatttttgctctccaaaatgagggtgtcttctggcaccttttgaaaaacagcagacctttcatctctcacgaggcactgtaacatacatgctgagagcttggttcctggagttggattcacagatttcacccctacacactctaggggatgccaagcacactgccaatatcgacatcttagatttataaattttacaattttttttttctggaaggtagccatagagtggcatgttcttaaaaaaccagtatatttcaataatttttcagcagatgaaagtgaggtatcataaagtagaagtacccttttctattgcaccattgtcataggtgcaagcaacatccctgtttaccacccattagctgtgcatatttaggcaaattgctgaacctctctgggtcctagcttactcatttccaaaatgggaatattaatattacctcctgtatcatggagctgttgtgaggattaagggagaaactagacacaaaacagctatgataggtcttgcaaatagtactcaataaattagttaatattagttccacaacatatacacaggcaaaacagaatcagaacttaaatcacttttaaaagatccctgtgcaaaaatgttattccagtgcagatcaggcctggatcccactgttcagttattaatacagtggaactggagtgaagtcagaaagtcaagttaaaggtagaacagatttaagtgaaacatagttctataaaggtaggactagcaacacttcagatgtttgaacagaaagaattcagcactgagtacttaggaagcatgtattcggaacctcagacagaagtggctgagatctgagtcccatgcacacattggagctgcctagccatgctaaagcccaatgcttccttctgtattagtctgcttttacaatgctgataaagacatactcaagactgggaagaaaaagagatttaatttactcacagttccacgtggctggggagccctcacagttatgatggcaggcaaggaggagcaagtcatgtcttacatggatggcagcaggcaaagagagcttgtgcagggaaacacccccttacaaaaccatcagatctcatgagacttattcactatcacaagatcacgagaacagcatggaaaagacctgcccccataattaaattacctcccaccaggtccctcccacaacacatgggaattcaagatgaaatttgggtgtgaatatagccaaaccatatcaccttctggaccccttcccaatgctctgtgcctcagtccaaatcagggaggatcaatgtcctcaacaatttacagtatttacaaaaaagtattttgtgactgtaaagcaacctgggtcttctgaatgagttgtaggaacatgtatctgcacattaatgatgtcagtggccatggtgagatagcatttgggtgatcagcatccatgatgctagccctttgaacatctgactcattgttcaacctagtggcagttctccagagagacacatggaaggagacagtatagaagaagggtaatcacaaatgttaaaggctccaaagtccaaaggctcaggcctgagtcttggctgtgtgtgacactgagcaacacagcctcagggctaccccatatggcaggacctataccacatgaggttgctgagtggatggaatgagttgacatgtggaaactgaacagcacttacagacacggaaagagacagtatagaagaagggtaatcacaaatgttaaagactccgaagtccaaaggcccaggtctgagtcttggctgtgtgtgacatgagtcttggctgtgtgtgacactgagcaacgtagcctcagggctaccccatatgacaggacctataccacatgaggttgctgagtggatggaatgagttgacatgtggaaactgaacagcacttacagacacggaaagagacagtatagaagaagggtaatcacaaatgttaaagactccgaagtccaaaggcccaggtctgagtcttggctgtgtgtgacatgagtcttggctgtgtgtgacactgagcaacgtagcctcagggctaccccatatgacaggacctataccacatgaggttgctgagtggatggaatgagttgacatatgtaaattgaacagcacttacagtgtgtattagctagtcctattattaatacagttatcatcaatgttattagaatggaccacctggagctttgaggacactctcttaatggacttcaggcaagtttggggtctgcactggatgcaggctatgggacctattcagcccttctttcccccaaccccaagcttactcagttggatcttcagtttctactagtctgtggacaagaaatggtaaaccctgaggcaaacacatagaatatgaaggaaaagggagtgtctgtctctgagtgccaagtagaccagatctagaccctagagcccaggttccaagaaggaggaagtgccaggatcatctttcttgagagccgaccaaggaagacatgacccaagaagacagagccttgttgtttatttagccccctgaaattcacccctcaaccccatcctgtagtcttcttgtaagtctttcccttggtctagctccctggaggccgaataagcatagagcgttgaccatgtgtgagttgtcatgtgcctctaacaagcaggattattcattgtgacttagttatccaagatatagatatttaccatcattctcttcagttttgttttggtaccaaagacaatagatgctaaatattccacaatatgagaaggattaacaaggcagatccctcaccataaatttatgaaaccattcacccttcaaattggctacctctctcctacttcttctaagcatccttttgccaaaatcatcaatgaacttctggttccaaacatagatcatttccttctcttgtctaaaagatactcaaactttaggataaaatttaaacccttgacctgccctaccaagccctggatgaaccccagacttatttctctggttccttcttagctcactgggcttctgtgcatgcatcttttcccatctactcgctgaccaatgccctctgctcaggatccttgtgccatgggaccccatgatggaatcatttctgagtttgttggcaactcatctccatttcctcctcatgcttctattcttccactgctctttttcattgcacactgtttattttgctttcagaatatttcttactatttgtaagaaatccacttgtttgtttacttaactaatgtttatcttctcttctagattatagatccagagggtagaggttatgaagacaaccaaacaattacaacttcatccaagggggtatattgaaagaaaccgagcatatttgctgaaagaatgagtttccctaaaaatgtttcttagtacagaaagtaattcatcatatattgttgaatcaaagagtacattataaaatgttaggcactgcacaatcctgtttaagtttatatatgtaaaatatctgtgtatataacttatatatacatttacatgcatatgtgtagagagaagtctggatgttgaggtcaaaatggtcacagtatccatcttagcatggtgacatcagagtgattttattttttaaaatttactagttttttaaatttaaatatttttaaatttaatttttttatatttaaaaggtatctgctaccttttaataataaacatgtactaccaatgtattcaataatttataaaaagaatatgatacaaattaagacccctaattttttttttgtttttttttttttttttggtgagattgggtctcgctctgtcacccaggccggagtgcagtggcacgatctcggctcactgcaacctctgcctcccaggttcaagaagttcttctgcctcagcctcctgaatagctgggagcacaccatcacgctcggcaaatttttgtattttcagtaaagacggggtttcaccatattggccgggctggtcccgaactcctgacctcatgatctgcccgcctcggcctcccaaagtgctgggattacagacgtgagccaccatgcctggccgagttaattttttattaatgtttagactctccaactggaacatgcccccttaatgaaggaaataatacaggatacatctgtgaaccttgtctctcttccccggtacatgtgttcatgtgtatgcatgtgtggatggacatgaaacaaaagcatacaaaatagcagaggagagagtataactgttcttgttataaagtattagatgataagttcccgagatgcagaaatcaccactacagatttcttagttatttcctttgttatgtttgctctcacacctgtggatcatatcgtgttgataaaaatctatattagtgacaggaaggctatgtggatcttctgagtattggctaatttatgtaattcgcttaatcaatttcttttaccagcatgaaatgctaactcattccaaaatagaaatcttaaacaaggttttaattaacatttgtattgctatgggcatgtatctgcataatgtaccctacttggtagatccatttatgctgcagtagagtgtcaataaagacgttgaaatccttctttatttcggtagtattttgtatctcacaaaactgtaacatctcttaattaaagagaatgttcatatggcttcattgtgagttaaagagttgaagctgcagatggattacaggattccattcatggtggtctgtgttcccgtctgtgttcctgctggggaagccaggtttccacagtcctactcctcatgactaggttatttcatgatcaaaataaaatctaggtttatatcatcacttgttatgtccaatatgagttcaacattatttttaaatagtaaattcacattagtaatctatgagttttcatttggtcaatataatttcactggtgaaatttttaaaaaagtaaaggaaaggtaatgtcctcataacaaacactagcagatgtaagatgggtcctattttctctgctttacatcattcctacagttgtagtgattacaagtgacatgaaatgaaatattttaaagttttaattattctaccagatttacagcagctctacatcatatttgtattcctatccactttacaaagttgacaaacaggcatttatgtcaagctttctggctgtgaacttagtattttcaccaataatttagaagaaagtaagtgaagaaaaacacttaaataacctaatcttgtgcaaaatggggatttccttaagacaaggaataaggtgcaataatagaggaaaaactgctgcttttacttttctttccctccttgtctttccagcattaataggggctactttcctttctcaactttgaaatattctaaaacatgttcaagagaggattcataactaaaactggagactcaggatactagattgtggccaatctatcatttttcccactgtttgccattccctgagggtatgaggtgtacacttgtcagggctgttgactttggagtccgacatgtaactggcagccaaggtcgtgatagcagaatgtctggaacagaggttttaaatgtttttgtgtggcttggcttgtctctgacactgctgtgatctgcctgagaagagaaaaccccacatacttactagcataagggagaggagaatcaagtagggccaatctggaccaatctggtacctggaggcaagtccaacctaaaccggttgagcatagccaatatccagccacctggagcacccatgagcaagagagagagatgcttttagattcaggggctatttgttacactgcattattgcagtaatggctgactaatacatattctatttttaaaaactggggcatagcataaaatatttacaaaatgaataagaactgatacaattatctgggcctgatcctcttatctggtagatgagaacactgaggcccatgatgttgtaacttgctccaaagtagagaagggaataggatcaaggtcttctgatgctcagtgactgttcacactgaacaatggcagattacatatgatggtgggatttgtaatgtaccctggatgatgctgtctacctccattccctacatgtgcctcactcactgtccatcccacattcttccttcctgcttcaaagcttctctatcactgacctacgcttgccctacattgtctatgttttctgtttagtccatttgggctgctataacaaaatatggttctggagcctggggaatctaagaataaggccccaggagattctgtgtctggtgagggcatattctgtgcttccaggatggtactttctctctgtatcctcacatggtggaagagacaaggcagccccttcaacatctgttatgagagcactaatcccattcatgagagtggagttctcatgtcttaatcacttcccaaaaggctctacctcttaatattatcacattgggtattaggttccaacatatgaattctggggtgacaccagcattcagatcacagcacctcagaagctttaattgcgtgctggcctctgggctgttaggtgactcagttcactctgggataatgcaacattggttctgttctgttggagactggtgacttaagtgagtcgtctctttaaatcacattctgtttccatgtgtttgttttgttatcccaaatcactttccaaatctcagattggcaggaaatcctaattaaaccctttggggtatctcagctatgaagcctgtagttgatcacgtgttatcattagtcagctaatttcatatgcctcccttgcccatcatcactttcaggtaaataagggagaacataaaatgaaacatctggcacacaaggtcatagataaaatctactaccctcagaatggcctctgaaaatccagttaggatttagaattaaggttggttctttccagatgccagttaactgaacccttgctctgaagaatcctcatctccttcagaaaaccttcactacatagtaactatggaaatttgcaactaagactatataaaacatgcttgatgttttttgaaagagaagcatattcttgttttctctaatgacttggattttacagttcacactgaatgcaaataataagactctattaccttcaatgcaaggatcttcaattagtctaggaaactggtttctgtattagaaaaatatgtgcatatctgttaagatgaacacatggcttaatgagggatcaacttgcctgtatattagagtttcagtaaaatgctcttggttttggaaacaaaggtttaagaggatacgttagctttatattcttacgtgggaacttattacctgacagacatcaagaagtgatgtcaagaatacctaaaagctatttaagtttaaatagtaatttaggtttattaaaaccatattagttatttaggtctaataccactgtttacagtgttcctgaaagattattacatagtccaaataatggatactgatggtcattgcatgctgaaatgacctgctggcttgtctgcttgactttgtcatcaatcaaggcaactgtggactctgctaaggccatgtcatgtaatccaatggaaaggtccagtcctatggccactgggcacaaggaatgtcagcccatcttggatgttgtcagtggaaatctttactgcatacagtgctttgctggtcagaccccactcagtatccttccagtttatcttccgttaagcacccagggccccctctgcaaaaaagtgaaggatcaactgcattaaggaagagcgattcccagtcagtgtttctgtcaatattaaaaccagcaaaaaagcaaatgtgtttagtgtgtggtttacaatggccagaacaggctctggccaagtctcaaagtgaatttcatttaagaatcactctcagcaactcaggtttatggctctcccctcaaaggaaataattctactgactaccattaaataaacatatctgttttcaacttaaagtagagcaaccacatgttccctaagaaatctagaagtcttttattggaaatagtacttaagaatgaaaatataaatccctatgactttcaaagtcctgttggggaaatactaatgacagggccagccccaaatgcagcaaagatgacaaggtacactcacaaatagagacaggattgagtgatgctgaagaccccaatgtctcctctactgatgaggtagcctgtctgccaaggtgccctcccgcttggtcacctccttgtgttcctgtgctgtgcttattctgtcatgctctggcagagatggtgtgggatgcagatgagatcccttccctagcagcacaggggtcactgtagggaacccaccaatgaacatttcttcctcagggtggaggatttactaatcaggctaaggttgggcatgtaggtgaatgaaactcgactccttacagtctcatacccaagcatgggctgcatcatggaaggtggagattgctgcattaccatcacaaaacctaacactgacaatttccttctaaaagtcccatgactcattttggttgtaaaaggtctaggataagtaaagaccacgaacaaactaaaatgtacttattgtatttttcacaaacctctgaaatatttattcttttctgggtaccattactgttcgtgtgctttatggtttgacaacaatgaaccacctctatccaaggctatagtgtgtaagagtaacctatgatcacaaaacattactcaaattaggaaaaaaagtatttcagacattccagacccaatggaaagactgattctaatttacacagcgaaatgctatggcaaactttccttttcttggtttttctaataaaaaaacacattcatcatgcaacataactccttactgtggttatggcaactctgaatacaatacatttgtactttcagcaacaataatcattttgaaagaataagcacatttctgttggtggtgaatgacattaatttttttctcctaaatcagacagcttatctgtggtaggtgttccacaaaatatagcagcataacgaggaggagcgtgatgcttatatcgatcaacttcaaacctacttggaatttttaagttctatttttatgtgattgctctattcttcaagaccaatttactttgctaaagggcatttttgatcaattagatatttatttctacagttgttataatattagcctaataaaattaagcatttcttgtacatgttgaataaaattcaatataaaggctaacttccctcaataggtcaacatggaaatcaactgtgttttatagtctgtttattgtgtgtgatgattttgtgtgtgtcaacttgactggctaagggatgcccagatagctggtgaaacattaattctggatgtgtctgtgaagcgaggatgtttttggaagaaatcagcatttaaatcagtaggctgagtaaacaagatggccctcagcaacgtaggcacacaccatccaatccaatgaaggcccaaatagaacaaaaacatagaggaagggtgagttcattctctcttcttgagctagaacatctgtctcctcctgcaatggacatcgcagctcctggttctctgacatttggactctaggacttacactagtggccccccagttctcaagcactggaacttggactgggaattataccactgggtcccctggttctcaaatcttgagactcaggctgactcgcaccaccagctttcctggttcagcttgtagggaaatgatcatgggactgcttgaccttcctaataaataataatcaatctatttatctataataaatcaataataaatcaataatatttatcataataaatcaatctatttatctatctactttatctaatcttctactggctctctgatttctctggagtactttaatgtatgctgcaaacaaaatctatttcttttgtttttaggagtatattctcacaaaatcaattcaaaaatataattatgagagttttgtctctggatggagggtgaaaaggctaaatcttgttcatatttattttgttttcttgttgctgctataacaaactgccacaaacttagtggtttaaaacaacacacatttatttatatcttatacttttggtggttaggagttgaacttgagtctcactgaactaaatgaaggtgggcaggactgcatttatacagaagcctctgaagagaaaattattattattattccttttccagctttcagaggctgccgaaatttcttggcttgtggcccttttccccatcttcaagttcagcaccatagactctctccggccatcttctgtagtcacgcctccctctgactatgtctgaaaaaggtcttctgcctttaaggatgcatatgattagtttgggcccacctggataatagaggataaactctctacctcaaggtcatttaactgcagctgcacccttacttcccttttcccatggaatgtaacataacacaagttttgggaattaggatgttaggcatctttggtgggggagcatcattctatcacaatatttttatatacatgactatttctcaagtatattcctcacctgtaagagctgtacatcccacaatgtgaaattgtaaatgcatgacactaatccgtatccttgtattctcagaaatgaaagatgaaaagaaaacatccagttattacattcactttttagaaatcaaaataaacttgtacctcccacagatgttgatgtgtgaccaaaaaagtgatttcaggagtcatctatgatgtattgtctaatgctatattctaaacagtaatcaagcagttattttaaaagctagttctgctgcatcatatgacttatgcctgtgttcttctggtggcagtttttgttgaagataaaagcatgaaaacattgagccaaggtaatcagaagagctaacatctatatatcttttttacttctaaacttcttcagtttctttgatgaaacagtcttaaatttcttaataaagattaggcatactgtacctcataggaattttcacaattacattaatatatttgatttaagcctatttttaattaattctatacattataatagttgatggccaaatccacaatacataagccaattaaaatatttcttcaaaggcagaaataaaatttaatatgttacatttgattttttgtgtttcttttaagaaagttctgccttgggatacacaggagaaaaactcaatgaaatgttcagtgacatttctccatacacatcaacataaatgtcaatatgcagtgaaaagtcttagaaagctatacaggaaatggttaacaagttactctggtactcatttaaaaaaaaattttcttcacaccatggcacaatagcacctttataaaccaaaccaaacaacgtaacataaaataatacatctgaagattcctgcttgctttgatactgggaaaaccagcagaacaaatcacttttagtttgctgaagaggccgtcaagtacagatttttaaaatgttctagtcctggctgacacttgaaaatagatcccacatgtttttgatgtaccactgtttgccttcaaattctggccacaatcttattaattcattcacaactacatgaaactcagcactttgctttcagtaatgaaaaaaaatgttatttacccagaaacacaagcttgatggccttggaaaaaaatatttacagggataaagcccttgatttaggattcatggacaatgacttcagaacatttgatgaattgcccatattcacagcctacaacataggttttaattcagaaataaaatttgcttgcaaatgtttgagatttttatctttcataggcatgaagtttatctaagccatcagggctcacagggtctatgttacatatgattgttattgaatatactgagactttatcaaaggtaagttttgttgttgttgctgctttttaatgacagacattactatatctctgaaaagaaatgtataggaagcttcttactaaggaacgcatatgtaaaatttccagtaacgattgaacagtactatttgtttcttttttgcatcttaggatttcaatcttattttataaacgtgtgaatctctgcaggtcacctaccctcctgctcaagatatgttctgttggtgggcattctggccagttggctggaccattccaggatggatgaaaatctgtatgccttgtccttcaagggcaggcctacaaataagcatgcacgtcagtggagttgggggcaggaaggccaaagatttccgagatgctttgcaagtcatctctgggcattcagccccatcatccagaggctctgccccactggaatttggatcgcctgttgatggctgaggttaagttgttcagactccaaagggccacaatgtaagagaaggccagtctccagcatttataaaaaagaacaggaggtattttaatgaaaggagagcacttactattatggcccagctccccatggcactttctactggcttagacatcccttctttttgaatgaaacataaatctttataaaaagattagtggggctgctttaatggttatgaaaggtaacagacttggggtagtaaagaaatttccacatcaaacacatgagataattgagtgtttcttggttttgtatccatgtgatgtattcataagaatcctacacaattaggtgtgtggggctcgtatcatgtcatattaagtctgcaccaggtatatatagctgtcagaataaattccattaaaattgctttctcagttgcatcaaacatccatgtgccaaagcacaacaatgatagtaatttagccgcaactgtttccagaacacatggtggactgcctagaagtgtacaaataaatcaaatcactagggttcgaatttcagggtggctggaggatgtgtgcacgccagaaactatttggattattaacatcaatgcaatacccaagtgttccattattggaacactaaacatgtgggagttatttatatcctactgctcaaggtcatcatcaaagtctgatttttcactgacgcaaaaattcaaaaaaattgcaacctccagcataaatgggtttaaggaggtattcccagttcactgtggatactggttatgacagaagggtccctcaacagtcagcgctactgctgaaagattccaattgattacctccctgggactatgaagtaccgataggcccctcaaccaggagaatttcaaaaataatttttcctacccattatacacaaaatcaagatgattaaatgtggagaaaaatacatccaatgaaaaatacagaacactgtatagatacacagactatatgtactatatatagatacagagcactatataatatctataatagtatatacatactatgtatacactatattacacacacacacacacacacacacacacacaggtatcctggaggtatcctggaaaatactctgtaaatgcatcaatctaacttgtgaaataaaaaactgagtattcaaatctgatttctgaacaattacaccttttacaagctggttcaggaaacgtgtgcatcgggacataaagaggtttatgatatttagtgaagttaagaagttaaagagtgatatcgtatgcaattcttgttttgctcgtaaacatttttcaattgaaagtttagtttcaacagttactctaataacttattagcattatacaaagtataaaatatattacctgccaaatagtatcaagcaaacttctatattctatttcataaagcatacaatacagcactcatgctctagcaagcaggatgctactaggttatgtgatatcaacgtctgtgagagttccctaccaatagaaaaaaagaaactcaaaatgttaggatttagttgctttttttttagtgcatgatgcaaaccattctctaccaaggctcatagagccttggtaatagctgcaaagaagatgtgatctaggatttgtgccaagtgttatattctatacaggaaaatagggaaatctgtaaaattctggcttgggctgaaatcagtagtttatgcttcagttgttgaattagacataattaggtaattccatattaagttcagaatggcatttaaaatgagtttggatatttccagtctttctttgcctgctgctagacagaaacatggctgcctctctggttcctgaattttaaagactttgtgtgtgtgtgtgtgtgtgtgtgtgtgtgtgtgtgtgtgtgtgtgtgtgtgagatatatgtgtatatctacacatacatgcaaacacacataagtaatatcacacacttatgtgaattactgcataaaatcaagcttaatgtataacctttttatctgctttctgactttataggattaatatgtgataagcgtactcccttatctctttcagaatgtattctttcttgagaagataaggatggagagatctactgaaaaagcaatgcacagtcctgtcatattgtcctagcatgacataaaattccatggtatgtcacactaggaaaggtcacactgacaagctgacagctgcaatcctgacagattctgcactatgacaggcaaatgactttatgtcctcaatgcacaaaacgcctgcaacaacaaaatgcatgttttcctttgcatttgcaaaacatcccagaaagcttcaattaccctcaacgattttccagctatccttggggaccactgcccatgtcctgatccaacaccttaggatgacaattccaccatccatctgagcattgcttagtactaatgccaataaatatttgctgctgttgacaagagataaacaaaagtagaacatcaaagtgctacaactcttcttttaagaacagataatattcaattaagaaacatttatattgaaatgcttgaagcactgaggttatataaagtacaaacagtccctgccctcctgtaaaagtattctaactgaaaagctcaggagatgaactaattagtcactaacaagactaaaaggaagtaagagccttggcccttgaatcagcaaaggcatccattgtgtgtaagtacatcgaagcaggggatatgtccttggctgggcctatgcctggcacatgaaactattctactctccaacagggccctaacatgggaacaaggttcacgagtacaccccaaatacctgcctaggtaggataaagaaaaacacatcctaatgagcaaacttacggactgaaacagaaagatatatataagccaattagacagtctgtcaccatggcaaagtctgctcatgatgaatcagggcaattttctcttttttctaatctatatcaaatgtctaaactctcaccatgttcaggggactgttcaggtttcattcccagttatgaaaggcagtataatgaaacaatgaaggtgtcagaaactcagcctagtcacgtgttcgtatgtggctttagccataacatgtgctctgagtttcttttgttcttctgtgaaatgaagattacaatgcccaaattgaaggattgtcaaaaggatgaaatgaaaccatatctgtgaaagttttctgtgaagaccactctgaaacactcaattttcaattacccaattttcccactttaaaaaatgtatgactaaagcagaaaaagcaatataacaatgtaaaggcactatatagaacagaaaggaatccttctagaatgaagaggaaggatgggcaaagagttcacacggggaagtgtttaatagctgcagagtttatacaattcatctttgaaaaaaactaagtgatttccgtacatgcaaatcaccttcccaaatcaagggaaatcaaatgaaaatgtagaagtcgccacaagaaggtctctgcagtatctcaggcagaagcattcttctcaaagtagggtaaatatacagagaggaaacactaccaatggcttaatcacagactttggtgatgactttggtgatgggtacctctcctttcgagtgtgtggcaccataaaatagtaggagaggcagggccagataaattctatctcgacgtccacaagaatgggtgaggcagaggtcctcagaatcacaaactgcgcacaacctgctgaccttggtaggctggagagaagtgaagtggaacaactcacacagaaatgtaacctgatatcagaaggtacttccctgtaaatgggggatgactcctactaatctagttatgctttccccgctccaaataaaccttttgcaagtacctgatctaggaagacttccaccaaaaagcgagacatagatcaagaagctcccagcatgggattgatatcaatgtaatgtaagaccaggttcagagaagcactggaaaaacaagtggaacataatgctccaccagaaaaagtagttattgagccgacgaatcatttgaacgaaatgtatggtcatgaatgaaaagaactgaatgaagcaatcaaatagctcagagcagaggtaaaagatgaagttcagacgagagaaagatggaatataagctatcagaatacttgaaagaaaaaaagggaattaaaaaataaaaaaactgattgccatattgtaatcaacccaaagaaactagacactgtccagaagaggaagaattgcattagaaacataaaccaagccaggcacggtggctcacacctgtaatcccagcactttgggaggatgaggctggtgaatcacttgaggtcaggagttcaagaccagcctggccaacatagcgaaaccccgtctctactgtaaatatacaaacattagctgggcatggtggcatgcacctgtgatcccagctactggggaggctgaggcaggagtatcggttgaatccaggaggtggaggttgcagtgagctgaaatcaccccactgcattccagcttgggcaacaaagtgaggctctctctcaaaaaacaaacaaaacaaaacaaaaaaacgacatggatgatagataaatagattgatggattgatagatgatagatagatgataaatagatagataggaaaaaatattcaagggagagagacagggaagaagacaaggagattcaaaatctgcataactggtgtgctcggggaagagcagcacataaatgagctaaaaagtattaatatacctaatgctaaatgacgagttaatgggtgcagcacaccaacatggcacatgtatacatatgtaacaaacctgcacattgtgcacatgtaccctaaaacttaaagtataataataataaaagaaaagaaaaagaaaaaagtattaaatataatttttttaaataatagagaagtatcattgcaagaaggcttgaatatgcagatgaaaatgatcacaatgccctaagaatagttgatattaaaaatttagcaagaactgtatctaaattagtatttcattaattggacttttgtagataaattataattagaaaaaaaattttttagagttcacttaaaaaaaagtaaattaaaattacaccaatctcagattttctcacagtaacagtctacttatgaaactattgggataacatctatgaaattctcaagaaaacaaaatgttatacccaggcagaataacatttaattatatgattacaggtcacattttcaaatgggaaaataggcaggaattgcaggggctgtaaaatcttcctgacaatcagaaaaaaaattagctaatgagaaaatgaggaaagaccactaatattgaactctagctaacgatatgtatgctaacgtgttcaaaggtaaagtcgattgctatctgaaaattattgtgaagtgcaatacacttcacaataatacaaaaattattgtgaatacacaatacaaaaattattgtgaatacaatggaatgatgagtgtcactaaatggatagctaataggtaaagcaaatattgcatatattgattgtacaatccaggtaatggttaatgggtgctcacaatacaattattttcatatttctatatatttatgacttttcataataaaatgatgaaaaatcacaaaaccatagcaaagtattgtctctccacatttattctatttaactatagtattaggagtaaaatatctgtggaaattactgtacagaaatcaattgtaaatcatggcaatttagaattactgtaacaaaagtccataggacaaagaagatgagagataagggatagagggatgcctatacaggaatcaaatagattctttaatggtgataaatcaattaatcaagatataaatactggaaaaaccaataaaaatataaccaagttaatttggggagtggcatacttagaatactttataatttcatctctggccatagtgggaagttgacactgtatttggaaaaagaagaaggctggctgcgcatggtagctcacacctgtaacctcagcacttcggaaagccaaggcgggaggattgcttgagcctaggagttcgagaccagcctgggcagtatggtgaaactccatctctaccaaaatatacaaagttagtcaggtgtggtggcacatgcctgtggtcccagctactcaggaggctgaagcgggaggattgcttgagcccgggagtttgaggctgtagtgagccacagttgcaccacggcaccccagcctgggggacagagaaagaccctgtctcaaaaaaaataataaaataaaacaaacaaacaaacaaacaaacaaaaaaacctgtattatatcaatttgtaattacagagttagccattataaaaactaaaaacatcccacattttcatattatgaaaagaaatattgcacacacttacacagaaaaagaggggaaaatgcaaaataaagatataaagagaaagaataacgtaaaatatgatatttacaatgtgaatgtgctacatatgcctccctttggaccacaaacttaactatacattgttgtggtaagttttaaagtatttacaaatatcaaatattaataatgtggaaaggcaaatcaggcaaattggaaaggaaagccatggccatgttctgagtagcagacacagttaaaacagggtagaaagcattcctgtgacaaagcatggccctttatgatgagtaagcatatactcagcaataaacatgtaagaggtatgaatatgtgcacacgatgaaaatattacatcaaatttaataaagtgaaacctacaagaattttttaaataggcagaagtatgtcaatagtgagggacttcaattcacatctctcagtccatgactgacccagtatacaacgaaagaaaaataatgaagatttaaacaacatagttatatctatttgtactttacctaattctataacctaaggacagataattgaccttccttcccagcaactgaggaaaaaaatgccaatcttgaagacatgctaggtcacaaagagaagttcattaaatatttccccacaaagttataacttatcaggatttatgaccaagaattcactcttgaattacaaaggaaacaaaaccagagatcgaagaacatttacaaaagttgtatatgaagtagaacctaggtaatatgttaaaagcaatgctcaggagacattttaagtctcgtacacatacatatgtaaataataagaaaggatgaaaataaatgacataagcatccaactgaaagaactagaaaaaagccaataaaatatgcatgaggaaagcaaaaggaacaagttaataaaaacgtaaatacaagaatgaatgcatttgaaaacagaatcatgttagacctattaagtaaatgtaaagttttaagataaaaaattagattgttgattaaacatcaaaagcaaaaataatgaagatttaaacaacatagttagatctatttgtactttacctaattctgtaacctaaggacagataattcatattccttcccggcaatcaaggaaaaaattgccaatcttgaagacatgttaggtcacaaagagaagttcattaaatatttccccacaaagttagaacttatcaggatttatgaccaagaattcactcttgaatcacaaaggaaaccaaaacggtgactggagaacatatacaaaagttatatatgagagtagaacctaggtaaaatgttaaaagcaatgctcaggagacattttaagtcttgtacacatacgtatataaataacaagaaaggatgaaaataaatgacataagcatccaactaaaagaactagaaaaaaaatcaataaaatacgaacaaaaaagcaaaaggaacaagttaataaaatcataaacacaagaatcaatgcattcgaaaacagaatgatgttagagctattaaataaatcaaaagttttgaaataaaaattagattgttgattaaactaagcaagaaaagaagaacaaaacaaaattagaaatgagaacagggaatgaatcagatagtgatgaaattaaatgctagaacataccattcgataagagaaggaaattaaaactgtgcatattaaaaaagaaaggaaattaccattgtttgcacaaaatataactgtataaataaaaagttcatgagaaccaatggaaaaactcttagacatggtaaagataattcagtgaagtgactgagtaaaaagtaaaaagtaaataggttgcctaagtatgtacaaagaagcatgctttcagatccaagatccatgcacaatagaaacaaaaagcataagtataaaaaatgtgtacaaaccatatgaacagcacgttgaaatgcttctttactacacaaaatgaccattgagtaagcggaatgcagactctacttaagatgggaacacaatatcctaaagaaagcaatgcatgaattaatctatatatttcaaacaactctagcaaaatatgaaagatatttttttctccagcaaagtaatccagttttaaagtaaacatgcaaaaacaaccagattttaaagaaaacctgccccccacccaaaaaaaaagaataaataaggtagcaatcggtaggaaaaacagaatcaagtatggataaatggtgttgaggcaactggaacttgtggaaaaaactaaaattgcattcctatcgaattcatcaaataaaaacaagttccacgagatcatgtcctttgctgggacacagatggaactggaagccattatcctcagcaaactaacacaggagcagaaaaccaaacaccgcattttctcacttataagtgggagctgaacaatgagaacacatggacacaaggaggggaacaacacacactggggactgttggtggcattggggaaaggagagcatcaggataaatagctaatgcatgctgggcttaatacctaggtaatgggttgataggtgcagcaaaccaccatggcacatatttacctatgtaacaaacctgcacatcctgcacaggtaccccagaacttaaaatagaatatcattaaatgttttaaaaagttggaagaaaaaaataaaaataaaaaataaaaacaagttccagagatacaaatgacaaacataaaataatgttattattagacaaaaatatgggaaattttgttttctgtagcctaagatagcaaagatctgagtatgatacaaaattatgattccataaacaacttagaaacttaaccacataaaaaataattatttacagcaaaagcaaaaagtaaacaaagtaggaaaatgttttgtaatttagaccacagaaaatagatctttccttaaactgtgagtaaatcctattaattatccattaaagaaaaaaatcaaccacccaaaaacatgatggatgagggacataaatgggtagttaattgaaaaggaaatatgattgctaagaaatgtgtgaaaagatgctggttttcttcaaaagagagatgcaaataaaaaacatgaaatgttattctcaactgtcagaacggcagaaataataatgctgggtgacatgaatcagccaaagagatatggaaatacacattctcatagtactgatggaaatgaaaatggataaaatatatacagagacaaatttggcaacatctatcacacgtttaaagtgtatataacctttgattcagaagactcacttctaggaatttatacaacagatatacggtgcatatgcaagcttattgatttatacgactatcagttacagccctgttcatagttgcaaaagaattgaacacaaaatattcatcaataaaggctagctaagtaaatgaagtatattcataaaataggaacaatgcagctgtttaaaagaaagaaaaaacatgaatgaagtattattcacataggcataatactttaccacttctgcaaataaattatatatttgcatatgcttatacatgcatagagtagctctgaaaggatacccgagaaactggtgtttgcctatgaaatgaggaactgtgtgactataggcagaaactcttaatacaattgcaaaagatgaacattataacaataataataacattttctaaaatcccttttccaggacctggcacacatacatatgattcattacccacagtaggtagccctgccacaaatactgtgaggtagatactttatttccctgggttccagcagtttagagaagttaaatgacctgctccaggtaacccagctctaagaggcagagctggtttcacactcaagcattccagctctggggtctggggggaggcaggtgtgacaggtagaataatgtcccaatccccccacaaatacgtttgcatcccaatccgcagaacctgtgaatgtgtaaggtttcatggcaaaggggagttaaggttgctcctcagctgactttaatgtagggagattagcctggattatccacgtgggtccaaggtaatcatgagttcttaaaagtggaagcaagcatcagagccggcgatgcaatgtgaaaaagacttgaatggccattgctggctttgcagagagaagggactaatggattgtgagtcaagagctgcaagttgtctcaaaaagctgggaaactcaagcagaactgctctagagcccccagaaagggacctagctctgccaacaccttaattttagaccactgagagcatttaacgctctggacttctgacatccacaatagtatgacaataactttgtcttaagccacttaggtgtgtgctaatttgttaaagcagcagcagcaggaaatgaatatggcagaaaagaatagaaaaatgaccacaggaagataaggaggcagtagggagcagatgggatttttaacccacgtctttcctcttggaactccttcctgcaagttcagataagaaaatttcatgcagggaatataggagatcccagccataccacccacaaacaggaacccaagagtacttctattagagcctggtacagaggctctcatgatgtggcaccaagaccagtagcagaagtgtcacctgagaatgggttagcaaatcaaattcttggacccatcttctggcagctggaataaaaatcttagagccatggctaacactctggtttgacaagtcctccaagtaagcctgatgtgatgcatgcctgagaaccgctggcttaatgtagctcttggtttagactgagcaaggcatccaaaatgttactgcacattggaatcacgtggagatctttaaaaaattttcacatctttgttgcacccaagacccatggaattagaatgcttaggcaggggaggtggcaataaagatccccaagtgaaccatatgcatgacagtttgaaagcactggtttagagcaatagttctcaatcttgatacattgaaaccactcagggccaattaaaatgtatagatacctgggttccatccctaggtgatctaattgattggtttacagcctgagtgtcaggaatcttaatccctagatgattctaatgcaaccctaaggtgaaagctagagcagaattcccacttgtagcacctgatcagagttaggtgccacatggtaaatgtgggggccaggagaagagtcatttcccaacccccagtcatttctgaaaagtcaactgatattcaactttgcaaaatagaaatgttaatcttatttttattccatatagttcaaagtattttcaagagttgatttattgtatcactgcaattgttgctactatttcctctttgacatactttctgctataaggagtgctaggttgaaccatctgaaattgcttgattggtccacatttgacatataaaacagcaatttcatattattcagcctaataacgagcattgtaatatacttccttaggatactaaaatgatggcattgagaagctcattattattgcacacctactagataatggcttgcaagcaaggagttatctgggaatttctaaaatgcactttaaaaataaaccccaaatgcctagtttaaatcacatgtggtgagctggacatagctgaacatccaataacaactatgcccagtgccctgatattcttctgtccatctcaatcagcatcagaaatgcaagcctcactgctcataccgagaccacccggtattgcactgaatgtctgctcatttgtccaatcaccccttcttccatcagttcttccagtgtgttctctgaaattcccctccaatatcagcagcataggctctgatcatccccactttccccaggtcttaactgaaacttgggcatcctctgtagacccaatctcaccccatcctttgcaacataggctgctgctcttcctgaccttcatcaggaccagataaagagaaggtccatccttggtccccatgctggctttcaaatcacagattggcaccacccatccatgtgcaggtccagacccctgctccttagaggctggttccagaaggctgcaccatcattaacatctgcttccagcctctttggcatccttcttgttccctgagctccatcatttgtcttctcatccctagacacccatcccgcaactgttggccttacctcatacttcactagaaagcacctctgaaggtgagcacctccttttctgaaattcctctcttttcttggcttctaggacaatccccctctaacctctcacctgataaaatgcccactgctggttctgctttgccatctcatccttcccctccaaacatcaactagagattctccagctgtttcctgaaccatctgcacactctttcctgaggtaaccatatccattttcatgattttaccatccacatatgaatttctcccacatttctatctcccaagtctctcttttgaactctgcagcctgactgcttccttcacacctctacagaggttctctgaatgccttggaggctccgggactgttctgggaacatcaataaaagtaaatcagtaaatcgctgcccacatggaccttcctttcaatgcaggagcagggagcaggtggagcagggagattgacaagaaacaataaacaagataaataaactaggtagcatgttagaaagtgatgagtacaatggggaaaaatagagaacaggctcagaggaaggtagaaactgttcacagtcacttaaatgtaaggttcccaaagctgagcctcagttcatgactccctcactttagaacccccatacacacaaaggcattgcttttcattctatctacaagcactgtccaagcaaaaacaaaacaggagtcattgcgactcttcagttttcctcacttgcaacatcagggtactcctgtccagcccacttttaaaatatatccgacttctacccactttcctccatctttgaaagagccaccctgttcagtcccaagtgcacctggattctctgcatctgttcctgttccgtcactaattcattctccccagaaccatcttttttttttttttttgaagcagagtctcgctctgttgccaggctggagcacggtggtgcaatctcagctcactgcaacctctgcctcccagatccatgcaattctctgtcctcagcctcccgagtagctgggactacaggcacacatcaccatgcccagctaatttttgtatttttagtagagatgaggtttcaccacgttggctaggatggtatcgatctctttatctcatgatccgcctgccttggcctcccgaagtgctgggattacaggtgtgagccaccgcatctggcccagaaccatctttgaaccatgtaaataaaattgttttcgtctgtttaaaatgcttaaaagtggctcgtctttgcactaaaataagatcccaattcccttcatgtacatataagatcttgcaagatctggcatcagtgtgtctcttcaacatcctttctcatcaatctatccttctactacttggcttgggatgtgttgtccttttgctgcacgaaacacatgaaatgcttcttggcctcctttgcacctgcttttctctctccccacaatgctgttattccagttatcatgagcggctctttctcttctttcaggtctgagcttaaacgtctcccaaaagctctgtttgaacatttgatatagaactgcatgtgaaaaggtaccttcaatgatgagtaaactgaggcacccaagtgggttaaatcacctgttcaaatggatccagatcaactacagaagctctgttccattaaaaataatgagacgagccattcatctcatttcctttagagcacgcatgtcccacccgtggcgtgcaggccacccgcggcccaggacggctttgaatgtggcccaacactaatgtgtaaactttcttaaaacatgagacatttttgcaatttattttagttcatcagctatcattagggtattttatgagtggcccaagacaattcttcttccaatgttccccagggaagccaaaagactggacacccctgttctagagaataaaattatattctctctccaaatgccattacagcttactcttgaaatacttgagaaagcaacaatgaccccttgttctgacaacttgtttgattataaacacgtttggtaaaaaaaaaaaaaatattttcagcaaggttgtcaaatctgcagatctgtttgtttttgaaggcatagaaataagagtagcatatccttgctgttttgggtgacggaatcatgcctgcaaaaatctcaaaaagactgtgaaacatgcagatgtggtcacaaggagtgcaataaaaatggaactgttgttcagaaagaaacgccagcatcccacagacatatgtgtggtcccatctgtgattctaaattcattgcttatgaacaactaaggagttgctggagatcagaagccatctctgcttttatcccttcagaagtaaggcggcatgcagctggatacatctacccctcctagaacttgagacaaatgacattcactcctgtctagacccaagacctctcatgccaatatcacttttcattcctgaaactctgatttaaagagacaggctctgaggccatcaacagttcctacctgatggttgattgttgatccacgtagccccagggttacagcactggaagagaccatgtactttagacccaagcttgagagcctgagtcccctccatggcaattctaacaagtgtgtttccatctccctgcttgagtactcacagtgatgggcaactcactgcttatcaaggcagtccatttttaaaaatagtttttaataataatttatttcttaaatggacttgaaactgtttgtttgttttgttttgttttttcagcttccgtttctccctgcactgtccaggtaaggaatgtgatcctatgacaaagaatcccttctgacctctgaagacagctaacacacctcttttcttttttcctccaatttaaatgccttcacttcattgagggtaacatgttataaatttctatgggaccacctcaaagggcttttgcattgctgagagtggacaaggttccaatgatactgtggcttctcccggacaaatacatgcatttgatttttgccagtttccaaaaacacttacaagaactgagttgaacctggctatcacttttcaaatttacattgttttcctaatgcaattacatttttttcttgtttatttcactttgttcatctgttgattatttttaaatgcctatactttcaagaagtttaaaataactagatcttgagaacctagaacataagccaaagatgtatgtctgtagctaaagatattttggccaccagagggctcccagattttgatcattattactctacctgtatttaaacaatcaagacaattaagtggacttatagaaacaacaaatttaaatataagctgtttctgacacaaagataggtcacaaatttttagaaacaattttatttgcctttgcctcttaattccagcacattaacttcttaaacactgtgcatatacacaatgatttaatccccacaatcttcttaaacacacacacgcacacaaagatttaatctacaaaataattagtcttgatctctgtaaacacatttaaatgttttatgacttacttgtctatatctgcagaagttttcaaatgactattttgtgtggaaagaataagtgttctgttttcaggaatatgtagctttctaaaagtacgtatttagaagtatgaatgatggcataaaattgacttgtatataaaattgattaaaaaataacgcttaatgtcaggaagtgtaagagaagaatcaacacttttatacatactttccagaaatgaaacttaataatttgatatgtctttgagggtaatttgttaaaatatggaatattgtaaaatgtacacgaatttatagtaagcagtaacttatctaagaattgattaaaaaatacacaaatattgggattttataagcaattttaaaaatagtaaaagtaaaggaataaggactaaaatgtcatcaattatgtgaggggaaaataaatcgtgggaccccaaaatcactaagcccaagggaaaagtcaagctgggaactatatcaggcaagcttgcctcccattttattccaaaataagatagctacaaagattaaccaaaaaaaaaaaaaaaaaaaaactacatagctccctcacaatttgcccactaggaaattccttgcgggccccaagatctttaccctaaaatagttctgttgcatttcaccctgacgagataaattgatagcttatcttcacaggtgcgggacgaaggacagaactcagtcattcctctgcccatctgagacaaatgcacatctgatttgcttcctctgccctatgtttattttatcttatgtaaaaataaagattcactgaaatttaaaattctctttctctttccccaatatctgccctttctcctttaaatccccaaaccctcaaaatcatctttggaggaaggcacagacctgtgtcctgggtgcacctcctcaatcgattgagacctgtctgagatactttttggtttgtaataagaaactagttaatttcatagcagagacagagagaggaggaagagaaggagcgagaagagaaaggaagagaaatacactatttcagagacttataatatttcagggttactatgaaatgtccatgaactcaagctcaacaatctgaagtcagggagtaaatggaaaaacagcaaatattgcacacaggattggggagggggaggcctcaaaggttttggggtttggagtggggcaagggctgaacaaggaggggtttcctgaaattctgcgtcctcgtgccccgcctgcacattcagctgcacattatgctgcttccagaagcatctcgatagcctaaggggtttattctctggctaaactgaaacagattattgggtatttaagatggaagtgtagatattttctgaaagttagtataaagaaaagaaccaaaagtcgaaaatttctgaactgtcaaaaaggaggagatttgtacaacaaaataataaagatttaaaaaaaaattacctccatccaggaggtctgtttgaacagtagaaattccagcgggagagaaaggtggaaagagtaggaatggtatcatccataaagaaatacagggaaatcaccctacattgaggggcaggagtgtttgcattccaagatgccactcagtgcccagcacactacagccacacacaccttcataaagttacgggacttcaggaataaagagaatggcctcaacactgcccacccaaaaggaagaaagtgaacttacacccgaaggtcagcaatcagaactataacaacccctaccctggcagctaaaagacaatggagaaatcattccctttgcaatttttaaaatttctaagataaaaattacttccaaacttatattctttttgcaaacataagttcttaaaaatgttcttctcatgcatcctttctcagaaatgatggatggtatgtcccgctgaaaggagggagaaaaaaagacatgggaaagcacaggatttaggaaataggaaatccagcataggggagacatgagaagaatacttaaggtggcagccccttcagattggaggctggtagaggggctcctggagctgtctctgctggaaaaacaaaatagaataaattccctgacaaagttgaacatgtggaaaatcattttgtgctttgaagtgtggaaatgttagatgtttaaagcaaaaaggaaaaatgtaatcatagcacacaacttggcttgacacttaatatttacatgattataatagatttaactaaaatgtaagacatactgggaggatgggaatatgggcaaagtgacctaaatttctgaaccatcacaatatgaagtcaataaatacatgaataagattgaaaaaaattaaataccagaaatttagttaaaaaataatgagagtgatttcttcgtgggaggaaaacggggaatgcattctcagttttttgttgttataatttctttataaccatatgacattaaaattatttgcatgtagtgtttgactaaaaaatttaacaatgaggcatatgtagtccatggaaaagtgctgtaataggttcagtggaaaaaacggttttagaataatgtaatcccatatattttcactgcaaaatgaaaggagaaatctattccaacatgtttaaaatgttaatctctggggcatagaattacaggggcctcttttatcttaataatcatttctgtcttctgagtatagcacatcaatttttaacctcaataaaccacaatgacgtaagtcatgttataattaatataaaataatcaaattggtatgttttatttcaagtttggatgcaaaagaaaaaaattgtgtaacttaatacacaaagcttttcagccaatgaggattcagtaactacgactaaaaccaagagtgctgtgagctcattaatgttacgtgtctgccttgcaggaaaaagctatggaaacacaatattaaagaaccttggatcctaaactgtatgccacggaaacgtggcaggcttacaataacgtcctgccaaagccacctgtgccatttggtgcctccctcattggagcaaggtttgcttctgcgaggctgtccaagagtccaagagctttctgccctctcttctccagcgccttcaactgaacagcattttgagcccaacacgaagcttactcttagtcatgcacctgaagtgttttgtttattaggtttttgagacaaagtcttctctgtcacccaggctgaagtgcaaagtggcatgattgttggctcactgcagccttgacctccccagctcaagagatcctcccacctcggcctcccaagaagctggaactacaggtttgcaccaccatgtatggctaatctttgtattttttgtagagagagggtttccccatggtgcctaggctggtcttgaactcctggactaaagggatcctcctgcctggatctcccaaagtgatgggattacaagtgtgagccacctcacctgggcatttattaaaaattactattattatggctaacaaagaacttgcaatattgattcagtagtcttagaatgccacatgtagaagacaaattacaaattatttttgtctagcaattttcttttcattacagacattttcacggttttcctccctagaccctagctgtcatattccattttctctagccatttctttactggtatttttctccctttaatgtgtcagagcggataaaaacataagtggtaaagattcagaaacggtagctttctttctctaaggtttagcataaccaacatgaacttcaagcagttagctgcaaattatctcatcaactcgagcactttacttctaaagttctgaccaatcctgcagaaaaagtcatctgtttgtgtgtcagagaaatatgcttatgtcaactctaagaaaccacattagggaaggaagcagggggaagtgaacttcactaggtagaggcctttggggccactccttccttccacaactatggggctctatgcctccagccaccacagctaggcagtggtagggcaggttctagatcttaggtgcagcaattttaacccagtgcttttaaaacaacatcagtaactgattatgcatgagacagtactagggttacagtctgctccgagggcttggccaagatttaataatgtaatcctccacaacaacctgatcagctggctatgatttttttcttattttattgctggagaaactgaggcaacagagtgtaaaccacctgcccaaggacacgcagctggaaagttctggagccagcactggctcccaagtagcctggtttcacactcctacgcagctattacacaagctctgacttaggagtgatctgctctaccattttatcagtggggacagcaaacaggagcagagattttattttactttacttaatttttatttttattttattatactttaagttctagggtacatgtgcacaatgtgcaggtttgttacatatgtatacatgtgccatgttggtgtgctgcacccgttaactcgtcatttacattaggtatatctcctaatgctattcctccccgttctccccatcccacaacaggccccggtgtgtgatgttccccttcctgtgtgcaagtgttctcattgttcaattcccacctatgagtgagaacatgcggtgtttggttttttgtccaaaacagagatatagaccaatggcacagaaaggagcagagattttctaaacaccatgttacttgcccagtgacagagctgtccagagctcagcctcccaaccctcctctctttgtggcagttttagttcattacatcacttaaatgtcaatggaatgagaatgtgtctgtgcataaatacggtgaatgtggacacttcattcttcagtgcttagactcagaacagatgatgtcacattttaaaatacgtgttctgaagaagatgggtgtacattaccttcatactgaatcaaattttaaattcactaataactattgaaagcaatccagaagcaaacccgtaaaactaaagaaaacttttaggaaataatcatattttaatctatcatatataaattctaattttcctaattgttaaaattttaatggaggtacacatgcatcttgttgtattggatatactgtttcccaaatgggaaaaatcatagtaaaacttcattttgaaataatgttattttggatttgtaatgaccaaaatcattaggagcttagagctttaaggtgatattgcagatagttcaaaattaaatggatggacagtcgatttggtttgtttcacttgtgtgtctgttttggaggagtggtttttttaaatggtttgtgtgtttaaatgtaaagtttttttaaaaagacctcatactcatttctcagagcaattatctgaggtgtgtcacattccatccccttctagaataacaattctcccaatatgcatgtgtgatgcagaaaccaggtgccagttaatgcacatcactgtgtggagagaaacgagaagagaaagggtgtttggccatgctgatggtgcaaacacagctgtgcacttcatatttttgttgctaaggtcatatgggtcagccctctcagtgggctacaaacccatttccctggcaaagcggacggtccatacggggcacggatttatttgaggagaagtatccatgttgttctgggggaataaaggggctgttcaccaaccaggcagagaccttcctaaaaagcagccatggcaactcagtttacctgcaagcaagaattgccagctacggctaggtaacggctcttaactttttaaaaactaaaggagagcagaatgaattagaaaagcagaatgtgctgcaggcacaaagagtggcaccaagagtggcacattcattttggacctagaggtggttaaggttatactgcatgtacaatttgaatagacaaaggcaagtactggaattaattacaaagcttattgggaatccaccagtgacataggcagtaactaaatcaagagggggctgagaagccatctgacaataacggccaacctaatggctgccatgctttccaacatgatagactgcggatgccgaccccttagataatagcctggtgttaacaccagcgcaaatatgaccaaaactgagggctctgaaattgggcagcggtcacctatcaggtagatcatacaggttctatgtgttacagaatgtgcatatacaactattgtcagattttgttatgggctgcatgatgtccctccaaaattcatgttgaagtcccaacccccagtacctcgggataaggtatttggacatagggcctacaaaggggtgattaaggtaaagtgaggtcatcaagatgagccctaatccagtatgactggtgtcattggaagaggtggaagtgagaacacagacacacacggaggacaaccacgttaggacacagagaggaggtgccatctacagtgttggaaggaaccaccctgctgatagcttcgtcttggacttagagcctccaaaactatgagaaaacaaatgactgctgttcaaacccctgctcagtggcatgtttttgtggcagccctagcagatgaatgcagacgatcatcaaaacaaaggcaagggccaggtgtagtggctcatgcctgtattcctagcactttgggaggctgaggcgggcggatcacctgaggtcaggagttcaagaccagcctggccaacatggtgaaaccagttctctactaaaaatacaacaattagctgggtgtggtggcaggcgcctgtaatcccagctacttgggaggctgaggcaggagaatcacttgaacctaggaggtggaggttgtagtgagcagagattgcgccactgcactctagcctgggtgacagagtgagactccgtcttcaaaaatatatataataaatattaaaaaaaaacacaaccaaaaatacaaaggcatattcagtactggaaaattccagaaaatggtccaagcaccccttggcatgttcctttgcagcatataatattccatttaattgttttttctttctttcttttattgtaggcaatacttttctttgtccatccagaatcctaacaagcattgtaaacaaataaacacataaaatagctaaaaatggagcagcagccgcgggagctgccgccctccccttcccccctgagctggaacagcccctggggctcccgcagagcagagtttgaaaaatgccgcttccattctggtgcctcacaaagatctaacatgtcagcgaattacctcaggtttgcacattatcattaatcaggggcatcacaggggatggcagcatcccccagacataataaataatggtgaactcaaggtttctgcaggcgagtgcgtgcgttctgcctgggaagggcagtccgtgtccattagagactgaggggaacgttgttcttgccgtgtcctctgagggttcccacgacgagaactgcgagggagccctgctcattcagagacccagtgcaggcagacccacacctgggcacctaggccagagaccttccatggagctctgcaggctctcagggcttctgaagattggcatctctccaggaaaaaaaaaagcccatcaccccaaacagtcagtaggcttgctgttgcctcacctaccctggatgctgaagttggagagcacttaaggtttccagaagtttctccagccagcaagatgctccaccctcctccttcagactgtcgtgcgcaattaatgacaagctttcatatctttgattgtgaaggtgcattagcacttcagctggctcctctgggtcactcttgggtttattccacgtttaaaccttcaaaatctgcttttatttaggtcttggcattcaggccagtgcccttcagaaggacacgaggatggcccatcttccagggctggactcagcccacctaactggctcagcaagatccctgctggtgtgaaacttgtcacaggatgtggcagggaggcttctcctagaactggactggggcccccttcgtcatgattgtagattagagtcaggggctctttgtgtgaccttcgtcctggcctccttatgatttgaatcacattttcctcagtggcttgatcaatgtgttcattcacgaaagtgctgactttcccatacaaaatggtcagcctggccgggcgcagtggctgcactttgggaggccgaggcaggcagatcacaaggtcaggagttcaagaccagcctgaccaacatggtgagaccccatctctactaaaaatataaaaattagccgggcttggtggcatgcgcctgtaatcccagctactcaggaggctgaggcaggagaatcgcttgaacctgggaggcggaggttgcagtgagcctagatcgtgccgtcgcactccagcctgggcaacagagtaagactctgtcttaaataaataaattaataaataaaatttaaaaaaaaacacatcagcctattccatttgagtagtttcaagtttcttttgtgtgtaagttggtatttcattccatttttgattttgtaggacattcgaactatctgtcaggttatccaatcctattaggcttctttcctccacaagtgtttcatctttgggtgggtgcttcactcccatgctgtactaaccacctcatagagaaagggactataccagaaatgtccttgtatttctataggagggtccccatttgggtgcttcactcccatgctgtactaaccacctcatagagaaaggggctatgccagaaacgtccttgtatttctataggagggtccccatttgaaggcccttagtgaaggtatatcgataattttagggagataatatggcatgagaaagggcagtcaactctgagtttgagctacagctcagccattcatcatggatacgacttggaccatttcttaactttcctgagcctcagtttagaggctaatataacccattgagttgttataaggctttaatttttagataacattaatatgcatatattgcatgcaaaatgcacaggtaagtgtctggcacatagtgatcaatttatcataataatattgatgatgatagtgacaatcacaaacatttaataagaggtatgtttaaaatagagtttgctcacaaccttatcagctaaaatgtttgtggtcttaactaaacaatgagctttcgaatgtgcttaaggtgaggacagaagggactctaggaatttcagaagactataactggggagttttgggggaaagaatttattctttgctgactaaccattggttaggtggtgggcagggcaggtcatagggaaagctttgatgggaagggctcaaaaatcagtcattgtaggctatgttatacagtgttccctgctaaggcctcaataagaagaatgagtggaaagttctctacgtgaacaatccaattaaccatgaactgccaaaaaaaacttgagggaaaattcagagagagtaggaaaaacgtttactttctcaccttagtcctgtgaccataattttgcaagccaagacctgataaaaataatgttcattttaaaatttaaagtacaaataagtatattttattgcatgaaatttggaatatttgggaagagctcaaagaaaacaaaagttatataacttcctaaatagtatttaaggaagactgcagtcagcccacaggcatttaggatctcaatgtggaaaagtataaaatgtgttttaatttaaaaagaaattttcaaaatatacctgttcaaacctcattcatacaatattcacaaataaagaggaatatgaattctttttcactgaatagtctagaaaaataaaaccagctctctatctgccatagaaaatcagaaattgatctaacaaaagataagaaccagaagaaaaggaaaagaaataggaaaaaggagataccatgcttaacacacaaaaaaggagatagttaaaaaatgataatggcaaaaaaaagaaaacggtattttttctgatcgtcttttctatagtagaaatttgcaatttctcagatgctcagtattgaagttccaaaggacgtgtaaatttccactgatggccgtgagtcatctataattatttccaccatatgtacttacatcctttccagagaacctgcccattaaaacagcatatgaaacttagtaagtttcacttttttatgttttggaagaaagtgataaaacccatactacttgaggaactgaattacacacagtgtttattaacactgagaggtctgcttttcatttgagcacaaatttgtaattattttagaatattatcaaaatgatatatttaatctaaaatccaatcatgcattttcatttaaattgttaacattttattcagtattttaaaagataaaataacaacattttctccactgacatttttttctgtctttttaaaaaacttgtcagtaaagtgtaatatacctagagaagagtacatttaactgaatagcccagctgaatcatcaccaactgatcccacccatgcaacccacatttaggtagagaaaaaaaattaccaggacccctgagccccaccccccatgcttctttatagtcattactcttctttcaaagccacccagtatcttgatttctaataggataggttcgttttgcctgttttggaagtttatgtaaatagaaccacacagaatatattctcttgtgtctgtctctcttccttcaacattaccttttcaagatttatccacatggttgtgtgtagttgttggctgttcattctcatttcttagctgtattatattgaatgaacataactccatttagctgtttgggggaatttgcatagttttttgattggagctattatgaaaagtgctgccaagaacactgtatatgcctgtgtgtacctgggaacctgtagtacatgtggacataggtaaatatttttttcttttggggacatagctgggagtggaatggctttgccatagggtaggcacagagccagcttttaaaaagattggtcattttccaaagtgattgcatgaccttaatttctatgcaccaaataaaatagcaaattgtaaaaagttacattgtactaaaattatagccactttttgttacatataatcttcaaaatatatggaacatcctaaaaaatcagttcttggccaatagggaggatttttaatttcaggtgttgaactgagattttgagcaaagaactataaatctaacaatgatcactactgttattactgctactaccacaactacaactaattacaatgactgcaacaaaataacaaatacagtagccctgccttatacacagcttccaagacccccaatggatgcctgaaacttcggatagtactgaatcctttatatgctttgtttttttctatacatccacacctgtgacaaagtttaatttataaaattagacatagtaagatattaacaacaataaataataataaaatagaacaattaaaacaatatactgtattctgagttatgtgaatttggtctctctctctctaaacatcttactgtactgcactcatgtattttcagaccatggttgatcaaggaaaactcaaactgcagaaagtggagctgcagataagggggaagaatgctgtaagaacagaagcccacctatgtgccaggtgctgtgctaagtgcttcattgcaatgaggcatttcaacgtctaagtaatcctataaattctattattgtcctcaattaaatgtgatgaagccagagacatggccatgagtaatttaaccaagatgaaaaagccactcaccactcaggtccattggacatgaaactcagctcttactaccctataaagcccagtgcttccatctgctcagggaagtacacaatcatcatcatcattaacggtgcaggggtaacatctgctcatctatgttttctgatatgcttaattccttagtccccttagaaacatctcacatatgtattagtccattttcatactcctatgaagaaatatccaagattgggtaatttataaaggaaagagttttaattgactcagttccacatggctggggaggcctcacaatcatggcagaaggcaaaggaggagcaaaggcatgtcttacatggcagcaggcaagagaaagtgtgcaggggaacttccctttataaaactatcagatctcattacacttattcactatcacgagaacagcatgggtaaacctgcccccatgattcaattacctcccactgggtccctctcacaacacgaggggattatgggagctcaattcaagatgagatttgggtggggacacagccagaccatatcacatgggattctccacatggactgacatgatttttaaaaatctgtcagcagtaaaaatgaatatcctagcagtgaagaaaaataagttgtaaatattttgaatcttattttcagacatatgtgtgtgtacatgcgtatgcatgtacgcacacacaaactcacacacacagctaatggtcttttgtgccaggtaaatgatagcaacatgtatgagatttgtttaccatgtcatttatttaattaaacaaaactaaatattgtgccacaatattttacccccaaactcagtcagctgtgacagaaactgcctgcacccaacattaagaaacaagaacgccagaaatgaggcagaggaaggtcaaacgccatttctctgggagtccttgttcaaaggctgctccagcctcacagcccagaggcagttccttgtgccctgacttaggctccttttagaaatctataggctcctgttagaaaaggaaatagtctctttctagatgtggctgtatacacaaaagttaaagaatcactaacacatgagataaagcatttcccaaagccttttagggaagagagagtattgctctttccctcctggtattcttccctttaaaaatctgaactcagtgtgaacaaataacaggtcagagactgagacagtcttgttcatagcctcacacacattaagttctatgcataacacattgaagctatatttttgcaaatatcatacttcattttctagaaacttgaaacatagtcaagaggaatttttaatgtttgtagacattacttatctctcacgtacattctgtattgaaacctatcttcatgtgacatatttacatgctacaattttgatgatagaaatttgacgctgttgctactgaaggttgtgaatgtaaggcctcgtgctggactgtcatattaaacagcgatgtgccacatggttttgagtgcagaaagtttaagtgacagtaaagaatgtacattaggaaggccattatcactgacactttgaatttcacataactggaccttaaagatgatactggctcaaggtcaaaaggcactctaaatatcaatatttatatcttttctctgatgcaatcagaaaacattttagtcaacctaccaaaattactgatttgggaaagaattaacaatttattctcatctgggaaaaaaacaactcttttaggccatgcttttgccctctgggcctaggatgccctacaccctgaaatgctgcagctagaaggcccgcaccagatgcggccctttgaccttggacttctcagcctccaaaactgtaagtcaaataaacttgggcatacactttttaaaacccactatttcaaaactattaaattcatttttcccccaacagaagctccctgcagcaaaagtcacttcctgtagaaagaccacaagaacaggccgggtgcggtagctcacgcctgtaatcccagcactttgggaggccgaagcagacagatcacaaggtcaggagatcgagaccatcccggctaacatggtgaaaccccgtctctactaagaatacaaaaaaattagccaggcatggtggcgggtgcctgtagtcccagctactcgggaggctgagggaggagaatggcatgaacccgggaggcaaagcttgcagagaatggcgtgaacccagaaggcagagcttgcagtgagccaagatcatgccactgcactccagcctgggcaacagagacagagcaagactctgtctccaaaaaaaaaaaaaaaaaaaaaagctcacaagagcaaaggaaagccttgctcaggaacaatgaaatggactcaaatacccagcatttttcagtatgagtggaaatgaccaaaaataatccaacaacactacgaaagtgtgattttcttcttctgatttttaaagttcataataaagccagaactatattcaactgtggaaacaacaaatgatgagactaaatcttgccatcctaacccacatgcactgcctagttacttcctgagcagctgcgttttggctctccatccataacaacccggagtggcagacaggacccgtgtcacagttgagtgagggacagagcaatttatgaagctacagcaaatgaaaggcagagctagacccggaacacacgtgcactgcttattgatccaaagtggatcctgtcacccatagaggcgattcgccgttcccagttgagtgtgaaaccagaaatctcagaagtgtctgaagtcactataattaccatggcaacaccactccggggggaagagcaagtgcagcctctcacctccttgtgagattatttctcatttatttgtacatgaaaatggctccatgtcaccttttttgtggccatccttgcatagaaatgaagaccatttccagtctttttattcacataattgcatttcttccctacatttcataattttaaaatatgaccacactgaacagttctaaacgtagctattgtacacttatgtagtgtcagaagcactttttctaacatgtagctttatgcccttatagctgtgggagagtataactacattgaaaacacgtgcctagcacccaaaataataaagctaatgactgtctttgtcatctgtagatatttcacactgttctttgctctctgccccttctagactcaacttttttatttttattttttaatatagagaatttttcagaatttttactcactacaacatgggtatactttgaaaacattttgtgttttaaaaattggactaaaggaaaaactttattggttttgaaaatcaaaaccagagaaatcactacattttcatactctctggagacatttcaaaaagaattagagcaaaaggtaacacacattcccaggaggtggaccctgacagcagagggcaataaatgtttgattctagaatttttgagtctcactgtttattttatatggaagccccctatgttttctcccaaagaatttcagcaagacaatttataactcttagcacactacctccacacttttaaaggtgtaaaatagagaaggtggaatgaggtggcagaatgtcttgcttctatcagatgtgtgcttgaacatgaggtgacaatacactgaatgctatcagggaggctaatgacacacagcccgcctaattgtgaaatttttattaaggtagagttgtggtgctgtggatgtaattattttttaaagtatatttgacttgctttttatatactgatcatctgtgtcagtgaaagatctcacaaaatttgatgacaaattagttgtgactaatattttaaaatgtcccacgcaattcttctgcatctctagaagattagaaacagaagaaatgtcatttaatgggaaaagtaaacatgcaggtgcatctgcagaaaagcacaaactcctcatgatcttgcaggacttacaaattagcaaatatctattttaaaatttccagaagtctttcaccattgtgagattttactttcatttcatgtcgaatctatttgaatagtaaggaggaaaaaacagctacctattatggataagtatggttttaggcatttatgatattactgtgggttatttttaagtgaaatcaacttaaacgggcaatatatttatttaagttggcttggttttagtgtcactggccaaacatttcaacaggaaattaccatgggaattatatctttaatagctatttctcctaacaatattattgtgaggatcaacaagccatgatgtttttgcctgattacacaatgataatttttttctttttattttcctgtataacggaggcatgttataattaaacataagttaaaatttcttaagctgtttgttggaaattatttatatataattcctttaacaactatgaatacccattaataaacctagattactatttgtccatttcaagcatcctatccctggaatagattagtgtgcctagttcttctcattttaacaatagtacccagacgtgcgtgggctccctggtacacacgtgtcttttgtgtgttcctaaagtttgctgtgaatgctttctatgactatggttctttccaatttaaaattttaatagaaagttaaaactctagatgtttaatcacttctttccttaccaaggctgaggaagtatttttaatttttctgagaggtaagcaattttaatcctgacattttggctattggccaataattacgaactgttaattctacggggcaggatgtaggtcctcggcaacaaaagatgttagacaaggttcttgctttcgagaatgtctcaacccacccaaactcatctaatcttcagcaggttccccacctataaacaaagtccacatccaaagactacgatttatgggtctgtccagaggcttcccgaatatttcaccgtctcaaatatattgtccggcagaattgtgaaaggtggaagtgggcagaaattgagtaagtgggcattaaatgccctatccagttcatccatccatcctatctataccttagcttgtctttgacttgactgtttacaactctgcagagatagaggttaactgatagaaaacataaagcaatgaaaacacttcctgtccatagcaaggcaaaggactcctgttctcagtgctgcaaatacattttgccccatagaaaacaaatctctgtggatagaatcttcaatggaaccagttgcaacatcttagcaattccctcattcatgaatgagttaaataaaatatttgactcaatgttcatctgctatttgtatgaaactcatgattttatcacctaaaaaagaaactcttggataatgttcatgggtggttttttttcctctggttcctgccactgcgtcatctcctgaagctgctgttctttctccagcttgcatgaggccaagcataaaatgcaactctctctccctcattccccaaagtgctgctgacataagtctgctgtggttacctgttttatacagggagatgtaggatgaggacaattgccacacagcgcaaagactgaaaaaatcctaaaatcaaatggtagatgctgtcatctataagttcttgtctatccctcctgcagagaatgttttggtgacgccaacagtcccagcctgtagcttcctgctctgtcatggaggtcacctttctttgctcctgctccttcatttccactcatctgcatgtccttgaagcttcctccagcagcttttagagacgcttccagagtctcattatgttattatacagaggaattgaagaactaggttttagttcctccgcctacatcaatttctggcctcactgacaacacaagactcactgaggtcccttgctactaagctccctgctaccccctttgcatccaccctccaaaaataaaacacagtcagccactctacatatttcaatatcacactgactttctttctttttttttttttttttttttgagacggagcctcgctgtcgcccaggctggagtgagtgcagtggcgcgatctcggctcactgcaagctccgcctcccaggttcacgccattctcctgcctcagcctcccgagtagctgggactacaggcgcccgccaccgcgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccacactgactttctaccagacacagaaggaactaatacagaaggctaatcatcagtagtttttgaatccaccaataacaaataaataaataaaatgtatttaagtttaaataattttattttataaattacatacttaaatagaacaatttagatgttacttacatgcatatgttatttctatttgttatttaactttaaaatatcttaaacctgtatacttaaattgtgtgtcaaatgtatattttatattgtatgttattatatatttatatacacacatatatacatacacatacatacacactgacttttcacacatatacacacagtctgaaatttaccttttgactaccaacacaattattacaccattacttttattaaatgtttttaaataggagcctcatttaaatctactgcatattcttttaacttgcttgtgtctaaaagtttttaaggcagcttacaaaactacgtactataaactgagggcagcaaaaataaagcctgagatatagctaatattcaaattacacatcaaaagaccctccctgattcctagaggtcagccatagatggctaacagatcacccaactataaggagagacccctatccactcagttgctagtgaatatacagtaacacagtcaacaaagcacatgaaatgcattcaccaggacttgggataatcacccggcatggtttatcctgggcctttctttccactactctctctatgactttcaactcacagcctttatactggctggtccttcccctcttgactgtcctttttcagatgactccagactgtccatcctagccaccaaccattgtaaactcagatcctggcatggagtatttactcaccaataaatgtcaagtaaaagaggcaggcaggcaggcaggaaggaaggaaagaagaaaaagagaaagaaaagaggaaagggaaggagagaggagaggagaggaggggatggcaggggagggagggggaaggagaaggaaggaatgagaaggccctcagggggtctggggttgtagcataaaagggcccataactgtaaaaaatgatattttacagttcaggttttaaccttgaagtgcacacagaccttaatacagcactgtttaagcattaggactaaagcttgaattttcacggggtaaactgatatttgaagaacctatgcaatatttcctttctagtttctaatgttccttgaatggctcaagcttgaaaccactgggatcaacatctgtcatcaaacagagcttgaaatcagctaccatcggagttgacatttgtaggacacctgccctcaccctggcctccgctgagctcctgcttggctccctagagtacttctgctccttcctgggtgccagtcctgctggcatggggtcatcagtgcctgcctttagcaactctgcttggtctcactttctgcttctaacagtctgggagcaccaggtaagcaggtggtaacaacaacatgcagactcagagaataagaccatgaggaactccacatgtttgaagcagggtctttagcacaaaggtttgatcctttaaatttaacctttcatgggccttttatgtaattcctggttctgacttatctatgggttcatggaataatctcagggtgagaaagcactttctccctctctctataacctgtaactctctctctctctctttctctccctctctctctctctctctgtgtgtgtgcatgtgtgcgtgtgtgcgtgcgtgtgtgtgtgtgtgtgtgtgtgagagagagagagagagagagagagagagagactgcctgctcacacgtagagggtaagcactccaggtagctataaaacatttcaccagtgaagcatactgctattgtctctcaggcaggcttgggtgttgcatgaggtgaggctggagggggctgctggagccacatccttagagaggtagaagtcacaccaagtcatgtgggttcatgctgagagtaatcagagctactcaaccatttccagcagagggatacatgagaagatttgaattttagcaaaatcagcataactgcagggtggggaatccattggaagggctgagggtgaaggcaaggaagcccgtgagaaagttaataatcttagagacggaaccaggggagaggcagtgaagatgggcagcttctagaaacattctagagagaacctatgaagctgcttgagggtgagggctgtttccagggagacatccaggtttttggcatgagttttcatagatggttctgctattcactgagataaggagcacaggagagagaagagagttgtagccagcatagtgaagaggccattgccagttgattagagtcaaatttatgtacattctggttcttgtacactctagatggcacttcgcaaactaaggcacattcaaatccctggggtatcttatgaaaacacaggcactggttcaggagatccagagaggggttgatgtttctgtctttctaacagttgatgctcatcttgctggtcagggaccacattttgaattaaggctccacattaatcaaaacttttcctgttatgcacccattctcaatgaacttaccaactctatgagtgtgtcgccctctctgtactccgcacctggaacagtggctggctggagacggacacctttgttgagccccagcagcaaagcccttcctctctgagtttctgcttccgcagcaagggctgctctgctaaagtgatgccagagagcttggaagtctctgtggagatcacggcttctctccatatcggggatccaggaaaagagacgtttggtctctggaaacttctatttgaaggctcagtcatgtctgaggttgtctttctgcatcagattgcctgatagtttcaatgagaaactgctgaactctgaagtttgactctgctgcatttcagggggagaggtaagctttttattcttttctgtctccgtgggcacagagtgacacatgcacagtcaagaagaggagaaaggcatccacccaaaggaaaaaaggtaaaaatcaaatcatctcactaaagacgccactgtgacaagggttcccttgggaattacagccagaatacctctcacctgggagggatattatagctcgaacagtgaaaagaaaaagctttatttcactattgtcttttccaattattgtgccccttgaaagattaagcaaatggtttatttttccttggcttcatttccagaatcacctttactggacacaatttaaattctagttatttccccaccaaaagccaacaaaaatgagttcaagagagttcacagcgatttcaaagagaattcacagagattctgcagccacgtggaaagaatattataggagattctaccatactatgcaatcctcatgtataataggatagtcagaggtcatgggcactattctctaggtctatgcttctaaaaaaccacaacacaaaagtaatgctataaaatttgcataaagaaaagaaaattttgtgatggttaatttgatgtcaaatcagctaggccacagggggcccaggcatttagtcaagcattattctgggtgtttctgtgagggtgtgtttggatgagattgatattttagtcagtggactctgagcaaagcagactgccctccctaatgcgggtgacctcatccaatcagttaaaggcctaaatggaacaggaaactgagctccctcaagcaaaataattcttctgctgatggccttcaaactggaacatcagttccttcctgggtcccctgctgactttgaacttaaactgcaacatttgctcttctcaaggtctccaacctcttggcccaccctgcagattctggatttatcagcctccgtaatcacgttggccaattccttaaaataaatatcttctatatataaataagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctactcgggaggctgaggcaggagaatggcgtgaacccgggaggcggagcttgcagtgagccgagatcccgccactgcactccagcctgggcgacagggcgagactccgtctcaaaaaaaaaaaaaaaaaaaaaaaaaaataagtaccattggttctgtttctccagagaaccctaagacatcttccatcccctaaattttggaaatggaaataaaaatcaaagatatattattcagttaggatacaacgtaagattttgtaggtgtgttagtctgctcttatgctgctaataaagacatatcagagactgggtaatttataaaggcaagaggtttaactgactcactgttccacatggctagggaggccacacaatcatggcagaaggtggatgagaagcagaatcatgtcctacatggcagcaggcaagagagtgcgtgtgcaggggaactcccctttataaaaccatcagatttcctgagacttattcattatcatgagaacagcccaggaaagacccacccccatgattcaattacctcctgccgggcccctcccatgacacgtgggaattatgggagataaaatgcaaaatgagatttgggtggggacagaaccaaaccatatcagtaggtctatgtgatttgctaaggacagtgttatacacaataaatacagtatttttttaaaaaaatggaatctataattggattctagacattttaatttcttttacttactatgtaggttcacacagtatattttcattacatggatgttgaaatattactttcccactgtgtggctgatggatcacataccatcctcctctccatgcaggaatcaggtaagggtatgtgagaggaaggaggttagggttgggaagtctttgtttaacttccacctcattcttgagaaaagatttgagagaggtctggctggagtacccccaccctgacgtcacaaagaggttgtctagagccatttggcagtgcaggcaggagcttctggcacttggtaggatgaggaccaattgttaatgtgctttctttgcttagtttttatccccacattctctcccactgtcctgcaaggtttctgtctcatggacatgaaaatgtgtcagtataaacaccagcattctctattcacacaaggattccttgtcactggggatttttgctgacttctattagtgtaaaaatcattcttcaactttctctaaaattgccaaactttggcaaaataattaattaaaacagatttaaggtcactttttaaactacagatgacatggatgagctccattattcttttacgtgacttgggcacatgaggaattcaaacataaaacttcaccagcttataaaatctgtgagtctctgcccccgtgttttaagatgtttgtaaaatttcaaagtattttgtcttacgatatcataaaagaaagtgcaattttagagtctaaaattaatttaattacgaacacttcaaatgtgttctcttattcttttttaaaaataaatgctttctagtgaaaaatctatttttctctttgacaggtaataaggcaaaattctgggaggttattggtaattgctctctttttttatctcatatctcctgttcacattgtcaacaaatcctacttattctacctgcaaaatatgaccagagagtgattgcttctgcctaacctttttgccacgattctcttattgtcaagcattgctgggactctggcaattttcccttgcaggcctgcctctttctagtgttgcacgccacccccaccctccagtcacctctgtcttttctcagttcagcaactgctgcagttgctaaaacagaaattagattctctgttcaaatccatgcaaaagtaccctgtaccattcaagggtattccaagggctgcaataccccaggtaacctgtctcccatttcctctctgtcctacctaccctccttctataaacacccccacacccaattcattcaacccaggcacactggcctttgtgctgtttctgcaacatgctagtcacactcctgccctaagacctttgcctagcttctctctctgcctgaaaagctcttcctctaaatacatttcaccagcaacttcccttcctttaagcatttcctcggatgccactttctcagcaagccctgtttgaagcattttgcccccactgactattgccaacccctatgccatcactcccaaccccccttcccgggggtctcatttctttcacacatgctacacataacatttgatcatactatgtaatttacatatttattaggtttgatgtagtacccttcttcccacaacagaaatcccataaaggaaaacttttgtctgttatgttcactcaaatatctaagacacctagaataatgaccagagtataataagtaaccaataaatatctttcaaataaatcaagtgatttttccattgctttagaaaaaaaaaatcctattctagtgcttcagagcctttgataaattctactttataatgcatgtgttattaggtatagattatagataatgaggataagttccacttaaattaagaaattggcttgctttctatttgaatataggtcattggtagccagttatataaaaataagaaaaaagaactaattgagaacaggctgacttcccaccacactcccagagcagattccaagaccaaagaaataaaataaaactctaaaggaactagaaatttatgatctttctcacaaataattcaaaaaatttttaagaaacctcagaactcttcaaaaaatacagagaaacaattcactgagatcaggaaacaataaatgatcaatattagaaatttagcagtgagattgacatttttttttaaaagcaaattctggagctagaaaatacaatcgaggagcagaaaaatgcaataaaggtcatcaacagtagacctgataaggcagaagaaagaatctgtgaacttaaagaagaaattatataattagaacagaaaaaaagaaagaatgagaaaatttgaagaaagtatacatggaattatatgaccaattcaagaaagcaaatctttgcattacaggagtttgaggcaaagaagaggaagactaagaggtagaacacttacttaaaaaactaatagtataaaactttccaaatctagggaaaggtataaatatacaggtacagaaaagtcaaaattttcaatcagattcaatgcaagcaagactacaccaagacatgctataatcaaactatcaaaaatcaaagacaaagagaggagcctgaaaacagcaagagaaaataagtgaatcaaaaataaaggggttccaataaagctagcagcagattcctcagaagaaaccttacaaaccaggaggaggtgggatgatacatgcagaatgctgaaagaaaaaactgccaattcaacaaacctgtccttcagaaaaggacataactttaattgtatacaaaatctctatacttttactcttgccaacacttatatttttaatgtcaaaattttacatttttaaatattagcttattattaggagaaataaaggaagaataaaaattgtcccaggaaaacataaagctgaagtagttcatcaccagcagaccccttttacaagaaacactaaagggagctctacaggctgaaagaacattaataaacaacacgaaaatatatgaaagttaaaactcagtctaagtaagtaaatggtcaaattaagtatactctaatactgtaatggtagtatgtaaattgcttatatctttagtatgaaggttcaaagacaaaaccattaaaaataatattagctacaacaatttgttaagaaatatgcaatattaaaagatccaaattgtgacatcaaaaatagaaaactggctgggcatggtggctcacacctgtaatcccagcactttaggaggccgaggcaggtggatcccctgaggtcaggagttcgagaccagcctggctaacatggtgaaaccctgtttctactaaaaatacaaaaaattagctgggcatggtggcacgtgcctgtaatcccagctactcgggaagctgaggcaggagaatcacttgaacccgagaggcaaaggttgcagtgagtcaagatcgtgccattgcactccagcttgggcaacaagagcaaaactccatctcaaaaaaaaaaaaaaaaatatatacatatatatacatatatatataaactgttgggcgaagtgaaagtgtagcctttgtatgcaattaaagttatgtcattagtagcttaaaatagcctgttataaatataagccacctatgtaatcctcatggtaatcataaagcaaaaacctatagtagacacacaaagataaaaagtaaaggatcaaagcacaccactaaacaaaatcacctaatcacaaaggaagacagcaagagaggaagaaagaaacaaaggatctacaaaacaaccagaaagccagtaacaaagtgacactaataagtccttacctatttacaattaccttgaatgtaaatggattaaattttacaacaaaaagacaaagagtggataagtggatttaaaaagaacacaacatgacccaactatgtgctgcttgtaagacagtcacttcagatttaaggacatgcatagactgaaaggccataagtcttaacaaatctagggagattgaaatcacatcaggtatcttttccaaccacaatggtatgaaactagaaatcaataacaggagaaattttggaagattcacacatacatggaaattaaacatgttcctgaatgatcaatgggtcaaagaagaaattaataggtcattttttacgtctaaattttaagtactaaaatatcattgagactaatgaaaacagagacagtgtgccaaaacttataggatgtagcaaaagtagttctaataaagaagtttttaacaaaaaaacttttaaattaaaaaaaaaagatgatttcaaataacctaaagttacacttcaaggaacaagaaaaaggagaacaaactaagcccataattggtagaagggaggaaataataaaggtcagtacaaacacaaataaaatagaactagaaaaacaatagaaaagatcaacaaaactaaagttgggtttttttttttcaaaaatagaaccaacaaatcgttagctagactaagaaaaaaagaagacaaaatcagaaataaaaggagaaacattacacctgatacaacagaaatacgaaggattataaaaagctaatatgaacagttatacaccaacaaactggataacataaaaaaacagataaatatctagacacatacaacttaccaagactgaatcatgaatataacaatctgaatagatcagagatgagtaacaagattgagtcaatagtaaaaagactctaatcaaggaaaaatccaggacctgatggcttcattgataaattctatgaaatattgaagaactaatcctaatcttccccaaattattttaaaaagtctaagaggtgaagcttgcaactcatttaacaaggtcagcattaccctgataccaaagccagacaagaacactctaagaaaattgcaggcccgtatcctagcaaaccaaattcaacagcgcactacaaaggctattcaccttgatcagtacgattggtccctagaatggaagaatggttcaatacatgcaaatcaatacatgggatgcaccacattaccacaatgaaggggaaaaccacgtgcatctcaatagatgcagaaaaggcttttgagaaaattcaaaattatttcatgataaaattctcaacaaattaggtatagaaagaatgttgctcaatacaataaagggcatatgtgacaaacccaaagctaacattgtacacaatgatgaaaaattgaaagttttcctctaatatcaggaagaaaataactatgcccactcttgtcctttctgttctacttctctggaagtcctaactggagaaattaggaaaaagaaaggaattaaaaacatccaaattggaaaaaaaagaagttaaattgtcactgtttgcaggctacatatcttttatgtagaaaattctaaatactccaccataaaactattagaactaatagataaatacaaaaaaattacagaatacaaaatcaacacataaaaagtagtagaatatttatactctaacaatgaactatccaaaaaagttatcaagaaaatagtctcattttttacagctgccaaaaaatagtaaaatatctaggaataagtttaaccaaggaagtgaaaaatctgtacactaaaaactacgacattgttaaaagaaatttaagaaaatacaaattgaaaaatattctatgtttatggattggaataattaatgttgttaagatgtccatattacccaaagtgatctacaaattcaatgcactccctatcaaaatggcatttttcaaagaaatagaaaaaaattagcataaaatgtatatgaaaccccataagacccccaaatagccaaagcaatcttgagcaaaagaacaagttggaagcatcacactacttgcctccaaaatatatacaaagctacagtaaccaaaacagatggtactggcatagaaacagacacacagaccagttgcacagaatacagaataaagagcccagaaacaaatccacacatttacagtcaatagattttcaacaaaggtgccaggaacacacattgaggaaagaacaatcttaaataaatggttctgggaaaacaatatccacatgcagaagaatgaaattagacccttatctcacaccatatacaaaaatcaactcaaaatggattaaacacttaaacataagacttgaagtaaatacaggggaaaggctccataatattgatcttggcaatgaatttagtatgtgaccctaaaagcacaggcaacaaacgtagacaactaggattatatcaacttaaaaagcttctgcacagcaatgaagacaatcagcaaagagaacctatggaataagagaatatattttcaagccatatgtctgataagggattaatatctaaaagatataaggaatgcaaacagctcaatagcaaagaaacaaatagcctaattaaaaaatggccaaagaacctgaatagacatttctcaaaataggacattcaaaaggccaatcgatacatgaaaaaatgctcaacatcattaatcatcagcaaaatggaaattaaaaccacaatgagatgtcacctcacacttatcagatggctgttatcaaaaagacaaaagataataagtattggtgaggatgtgtatcaaagagaaccctagtactctattggtggaaatttacactggtacagccatttttggaaacagtatagaggttcttcaaaaaatcaaaaatagaactaccatattatccagtaattccactgttggatctatatccaaaggctgtgaattaaatcagcgtatcgaagagatatctccacctccatgttcattgcagcattattcacaatagacaaaaattagaatcaacctaagtgtcaacagaagaataaagaaaatttacacaagtaaataatattcagctttataaaaaaggaaattctgtcatttgaaacatggctaagcttgaaggacattatgttaagtaaaataagccagacacaaatgacaaacactgcttgatctcatatgtgaaatctaaaagaattaaattcatagaagtagtgagtagaatggtggtttccaggggtgggggcaggggtggggagttggggagatgttggtcaaagacgacaaaatttcagtcagacagaaagaataagttcaagaaatctatcctacaacacggtgactgcaattaataacaacatattgttttcctgaaaagcccttagagtaaatttgaagtgttctgagcataaaaataagtatattcagtaatgcataggttaattagctcaatttagccattccccaatgtatacatataagaaaacatcctgttgtacacaataaatatatatacatttatttgtcaatatacaaataaattgtttaaaaaataaagttaattgggattgcttttcataaagatcagcttgcatacatttgcctttgcagagttttgcatcactaaatggaagctgatttctaacttgtatttccagctatgagaactgctatgttggaattggtcaaaataacgtggattttgaaaccactaaaattatgaaatatgaagtactggatttcgagtataatccaacagactcatcaaagtctagcacatggtaggttgcatagtaaagtgttaagagtatggattttggcattagatctgggtttcaaaatctgcacatgtcataacctttctgtgtctcggttttcctcatttataaaacgggaataataactctgtgtcattgggctgcttaaatgtttggcacagtgcctccttcacaatgagagttcaggacatatctcattttgttgccaggaggaattactattgtcaattgtatatgaaggcaacaatgacccaccattacgagctgagtaaccttaaagagctcactgtatttcagtgagcctcagtttgattatctaaaaatgggaatacgccacacctgctctgcaagactgctgtgaggactaaacaaagcaatgcgtataaaaaaccacacagtggctggcccatgggcttccctttctgctgtagatgggtgttttagagacaacttccctaggattggaagaaaggtggtagaaactgacttctgtataaaccagcaagattataaaaacagctgcctggcattgttcaggatttataagcacatgtatttcacatatacctatgtaaacatgaatatatatacagtatgtgtatatatatataatatgtatatatgcactatgtatatatatatatatagtgtgtgtgtatatatatacccatatatatatatatatatatatatatatagatatatatatatgggtgtatatatatatgggtgtgtgtatatatatatatatatatatgggtgtatatatatatatgggtgtgtatatatatatatatatatatatatatatatatatatacccatcactgacagatatatgagagaaaaaatatggtacatattataagagagtaataaaacattcttacaattctcaaatagaattttagaatccacagaatttctcaatgctaagaagggagattaatttaaacacaagagaatttctcattatagcaatgtaatacgcagctcattctttatcatgtaagagagctggagctataaataatgccttgtagtatgagtaataattcctgaaaaaaattaactggaatgaagcaggtttttaatacagtattcaatgaaatcatctaaatttacctaagctagaaacagactactttgaaataagtgtatgaatacttgcagactataaaagattgaaaagattactactattttatctgtttatgtggtcatataccacaatagagtaaaacaccatatgtcaaatatctagacagctattgaggaatctagctcaacaatacaagtgatcctagccacaagattaaacagttctgacacaaatagtccatctcttcacaggtttctctcttgctctttgaatacctcaatcagacattcagattaaagcaaacaaaaaaaccaaaactctactacatataggatgatagcagccagaaccttccaatctgtgccagcctctagatgaaagatctctgttcttatttaagaaggcactcaccagcaacgcatgtgtctcatttactatgtgggacaaactatgatccaacgtgcccattaagtttctggggaaagtttaagaaataattagggaatttaactttacttttctcttgctcttttccaaaccatatctaagacagttgggttaaagaagcagaaatgcaattaaatttagcaaatattttttgaaaacttctcagatgcatagaaggaagtcatccaagtgtctgtgctggaggtgaagatctgagcacccttctttttttctttttctttttcttttggagacagtgtctcactctgtcacccaggatggagtgtagtgatgcgatctcggctcactgcaatctttgcctcctgggttcaagtgattctcttgcctcagcctcctgagtagctgggactacagacacccaccaccacacctggctaatttttgtatttttagtagagacagggtttcaccatgttggctaggatggtctcgatctcctgacctcacgatccacctgcctcggtctcccaaagtgctgagattacaggcgtcaggcgtgagccactgcgcccggctgagtacccttctttaggaagaaaacttcagcagtactgggagggaggaggagaaaagggagattgcaggaaaaaagtctcaggacaacacatgatttgcttctttttgcctttttcctaaatatttatgaaatagtttctaaatattttgttttttaagttttctgaagaaagccctttaaatacatatatttcataaatacaggatttatgtcttgttttatgagtaacatagacattctagtaataaactgcttatttctgtagtctatgtctttatgtctttcaactgattaagactcctgcttctattaatttttccagaaaccttccaggaataaatatctgttttaaaagagagattaagtgaccagcaagacctcactattgaatgtcaacttaactattttctttccaaatcttacttttctttttctaattcacagcttcatggatgcagacggtactcttgaccttggagatctacatcatattcttcagcatattaaagctccagaagggaagagatggcaccttcaagctcaatcattaataaaggggcaatttacaaagccagtgcagtacccaggggctaagagcagctcaaaactgtcatcttccctaggcatggagggttagtgggcaggagtggtttcagagcaacctgaatgggaaggagcaggtgaaacaaaatcaactctctaacgatactgctcttctgccctatagtctcctgctgatgcctcccattgtggaacctggtaggaagcccatgacctgggagcccattgaggcagccagcctcctggggctcagagcagggtgaagacagggaaagagtgggcttggagaggcaatatggtaggtatgcagcacgaggcttctctttttaaagagagcaagctcaaagagaatttcattgcagagatactccaaacaatatctattactgcaaatattacttcatacagcctaaaggtagaattagtagtctcttctcagcagggttaccatatttagctaatacaggacaccatttcaatctaaatgttagttacataatgcataatttttaggataagtatgctccacacaatatttggaatatactcacactaaatattatgttttgtttatcaggaattcaaattgaactgggcatcctctattttatgtgacaacctcacctctttgtatattaaaatatatattcttcaaatacatatttgaagtattgttattacttctgtcccaaacactagaggaaatgatgcgtttctacccaggtgtgttatatttagtattattcctgtgagctttatatttgtgctccccttttcaatctgtgtcttgagtcctccatttttaaaaattatgctccctacttttattcattgtgatatataaagactgtctccacagagaatgtactgatttcactgaggtcatccatgagctgcctcttttctcatgagaataaatttttaaaggcattaagcttcgtattcttttattttttgttttgagatggagttttgctcttgttgcccaggctgaagtgcaatggcacgatctctgctcacagcaacctccgcctcccgggttcaagcgattctcctgtctcagcctccagagtagctgagattacaggcatgcaccaccatgcccagctaatttttgtatttttagtagagacagggtttcaccatgttggtcaggctggtccggaactcccgacctcaggtgatccacccccaccttggcctcccaaagtgctgggattataggcgtgagccacagcgccggctaatggattattaatgttctttccggctgcagtgattttctaattttgcttttgaattgtatatatcttgaagaacttagaaggtttctcattctttcatatatctaaaccagggactcttaatctggggcctgcataccctctatgcataaaattcaggaagctccctgaagctgggtataggaaaacatttgttctatttttcactaacctctaactgaaatttatcatgttttaaaattattaatataggcaacaaaccacagtagtattagtactgtgacttcatcatcaataaaaattactaatattttcaaaatcacatttcagatatagctctctatacatttttattgacactaataacttcttaaaatttgctatggacacaaatctagtgtgtcatttaataaattaatcaagaagaacatatcatacatcatggattttatctaatttgataactgtattagtttactattgctgctgtaacaaatcgccacaaacttgatgacataaaagaataccaaggtattatctatagttctgtaggccataaatccaaaatgggtcaagctgggctaaaagcaaggggttggcaggccgtcttctttctacaggctcaaggggagaatctattttcttattttttccaatgtctagaggctgcccaaacccctcggttcatggtctccttccatcttcaaagccagcaatggcccatcgagtttcccattgcatcactctgacacgggttctcccgtctcttccttctacttttaaggactcttgtcatgacattggactcacccagataatccacaataattttcttatgtcaaggacagctgagtagcaaacttaattctatctccacctttaatttccccttgccataggacataacatattcacaggtctggcaactaagccacaggcatttttggggagtcataattctgcctaacatatatattagtaataatttgctaaatgatttcctttataatattatgtataattttttttatttaacaaaactatcctgaggagagttccatgggctccatgagtttgccagagagctctacggcacacagcaggttaagaacgtctcatttgcgacagtgatgctgacaattagaaccatagcattcctttaaggaaatatctgctacaaagtcacttgcatatgttctctttacttcctacttcccaacgttacgcattaagaatatctattatgctacttttacagaagaagaaaccagggtttggagagtgatctgccaaaggccacactgctgatgggttgcagggctaaattcaaagagcgctccaccgaccttggagctgaggctcccatgcttcaagtcttcttcgagcattgccctgtattcactcaccgcctgatatgcttcgaccaagaggatattagtaccagatgagtatcagcctacactgtttattccccctcttatggatgcatctgaccagactagaaatgttatctttgaaaaacaaactctagctacctctgtccccagctttcctgcattatcagagaaaactttattaacatgcacttataacaagactagcacatgtttctcccaccaactgttgtagctagaatgagcaagtgagcaggtggcagtgctatcaaggagctgtcagatgccaacttcacgctgcacatccgctgattttcagtgggttaccttacctcaggtagctacaagaactctcaaacaaaaatacactgaagatctggaacacaaatctttaagtcattaacattcgtctctttaatttcagggcttacccagggtcctattttctctggatttctcaagccacaaagattaagatctagctctgattttcatgtatttgtttgatttggttttggttttagttttggctggatagtatcttcactgtgcaacttggaaccgtatttgacctggtaattcaggtctgaattggcactgatttacagccactgtgaattgatggtcatgggttatcattgtagttggtcatttctgctagttcactgactagtggaacctctcttccaggctttcatcagaaagatgctattggatatttcaaaagagcaccagagctccccaacagtggctcataaacgtttctggtagaacaaatccatgggacacaatatctcaccgtgactcactgttctatctggccagctctagaaatgaacagtctgaggcttagaacattgaaggaaaggaaagagaagagaagaggaaagaagaggggaggagaaaagaagagaaaagaggaagaaaagagtggggcgaggagagaggaggaagaggatttgtttatcactcaataacaccaagtctgtaccagggatgttggccgactcctcagccaggagggcatcaagaatcaggtcccagcaatggtgatggccacggggcacacagctgtccctgccttccctgttctccatgccttctctaagtctgagtacttcctcctgcctcagccctccctcgggagaacagtccacctgtcactgagaacagaattctcgatgtggaatactgtggttagcgggcattacattaaaatatacaggatacaacaagctttaacctgtcagcatggcatgacactcgttttagaaagcaaaataaaaaaagaagaacaacagaaaaactacataggcgatgcgaaaggctcaaataatgcgtgacacaagatgttaacagctgtttaagacccgagctgtgcaacttctggggccgctatccatcctgtgttccaatggaacctggactcccccttgaatggttcaatacagaggacctgattatggatctctgggggtgaaactgcaagtgcattttatttattttctcagtaactatttgcagttttaagactatccagtggaaacatgcattactttattatcagaaaaaaatctttttatttgtatttattcccttatttgtatagtatacagataagatatagtaagagttgactgtcataccagctctcatgtctgcctctgaggctggaaatcaagggctgtttatatggttctctggtgctatgttactcagaagattcaaaggaagactgaggccaccaccaggtggaaggtaagagcctatcaatgacttggttttgtggtactgtgtcccacctcctggttgcccatttttcacaggtaattggaaataatgggaaagccttaagacaactttgagaatgagttagaaaaatcagtggaagtggatttagcctatcatcactcacacagtacagagactcaaaccgtgacaggcagctgggttcaaaaactgccagagattcagcacagtttgaaaatgacaatttttttgttgttgcagttttacaaaggaaaacaggatagagttatttccatgtagttgagtattgttacatgctaaaagatttcttccagttatttttagccagtttatttgctgtttgataagaataggaaagtttagtgaaagtcttatgattcacagcattctgagaaaaaaaaaaagtctggtaaattctaagaagaagtctactagtcagagctttctcagtccctttacaacagctggtggcttgcttaaactgtcttatggaatttcagacatatctctaaaaggtaaatactataatgaatgtcctacacttgataaacatttggagtgccttaattttcccacctgtttacagggactcttactaagagaacaggctgttgctaaggtacagggtggctgtcagaaacttctagcttcaaatatgccaattaaattactctttggggaagctcggctcatcacgtaaaatcactcgaggagttactctatgattgtgatatgcagtgcttctcatttaaaatcccactacactccccatatccagtccctctgtgtgtggtgataacaacattcttgacttttaacacttcgccaacaactctattaatcaaagtgtgtgtctacaggagacaagcaaagtagctgtatctgactcattttcattcaagaaaatgttcaaaatgatgcaaagaaccacacacacacaaaacaagatataaagtcactgctgcaaagtgaaccacggatatgatactcttaaactgacttgtgcttttttccagattcttaaagatttactgaaggaacttttttactaacgcacttcatgcttgcatttcaaaaatgtgtaacgcattttataagctactctgttaatctcaaagatgaatgagcatcggctaggcttagctatcaactgatctgaagcccatgcacgaggggacagtaatgacactcatcccacctgattttgagataagcaataaagagtgaatattctagcaaataaaatcttcaatttgaaaggttagatgccatttctcagaatgtgctactgcctgggacgtccatgatgaacatgaaaaataccagtgggagccccggactcactgacttcacggaggaaaagtaaaacaagccaaggttgtttttaccacttatttgctccttcttgcttcattggaaaaatcaagtggctcaaacaaaatcggcttaattcagatataaagtgcttaaatggtatttgataaccagtgaccccagattcaggagagttagcagccctttcacatttccaacaccacactgtcgagtttgtatatatggccaaagaaaatgtggatctgtgatgaggactatgtgtcaagattatttaaagcaaagagcgagtaacagtcgttaggctgcagtaagagaattcaggaatcactaggtatatccaggaagaagcgtttttaaaactgttacattggaaacatcagattggtggttataaagggaaaaagatatattttatcttattgtgttaccaaaatatcaactttaaatataatacaaaaaatattggtctagtggtaatcaaaagaggaaaaaaatattttgccctactattactaaaacataaatcacaaatacaaagcatattatcagagaagttacactttgattggaaaaaaactttctatgttaaaataacagccacaacttggccaggcccagcggctcacgcctgtaatcccagcactgtgggaggccgaggcaggcagatcgcaaggtgaggagttagagaccagcctgaccaacatggtgaaaacccatctctactaaaaatacaaaaattagccaggcatggtggcacacacctgtaatcccagctactcgggaagctgaggcaggagaattgcttaaaccctggaggcagaggttgcagtgagccgagatcacgtcactgtactccagcctgggtggcagagctagaatacatctcaaaaataataataataaaaataaatttaaaaaaacagccgcaactattcaacaccagtagcagatttcagaaaatagtcctatgcatcattaaagcatatagctcttctatttgtcttacgggtaaaaaatacggcatttacaactttacatacacactgctgtatttctatagcaggcaaatcacgtactctaatgtccatcttacatttgtgaatataacttgcatctacagctggatgtggtgactcacacctgtaatctctgcactttaggaggctgaggtgggcggatcactcgagctcaggagtttgagaccagcctggggaacatggtgaaacccctctctacaaaaaacacaaaagttagctgggcacggtgttgtgcacctgtagtcccagctactcgggaggctgaggcaggaggatctcttgagcctggaaggtggaggttgcagtgatcatgccactgcactacagcctgggtgacagagcacagcaagactctgtctcaaaaaaataaatgtataaataaaaataacttacattcacaggagactgttggagctgccctctggacagcctatcacagagcagctttctctgtaccccctcgcccctccactcctgcatacagacccttttcctgaactgctctcctagagcaccaatccctggacctttgtaaccaaaacccaccggtatttgctaaatgtacctgtggaaaaatgggtacagttgagtcacttttattttcctaagtggagccaccctacatggagagagtatgtttaatctggttgtagagaaggggatggagtatggacgcagtgtgggtcccagcagattccattctaggaatttcaacactgatttatttaatttctgactcacactgtcaggcagggaagaaaccatgaactgtgagtatttaccattctgagtcacttctatttgcgaaagcaaatcaccattgcttttgtaacttttagaaaagaaataaatcaataatgaaattactaaaatggaatatgctgacagccacactgcacccacactttaaatgggaatcaatatgctatttataaatcaaaaagagaagggaaaagatctcaaaagtctgtttttggattattagaataactctattatgtatttcaaatgcaaattgtaatggtaaaaagatcccaagcataggttaattgaaatcaaattaaaaatgttaactaaacagtttggcatttaaatatggagacaaacaacattttaaaattagtattgctgttgttgttatcatcattattattatttaaagatagagtcttgccctgtcgaccagactggaatgcagcggtgcagtcatcgctctcagtagcctcaaactcctgggctcaagggaaccacctacctcagcctcttgagtcactcagaccacaggtgcaaaccaccacacccggcaaatatatatatatatatatatatatatatatatatatatatatatatatatttttttttttttttttttttttttttacttttttatagagacaaggtctctttatgttgcccaggctggtctcaaacttctggcctcaagtaatcctcctgcctagcctcccaaagtgctgggattacaggcatgagccattgtgtccagccagaaaaacaacattttgacaaaaggaatgatggcaaaatgctacatttctaaggtaaaattttggttattaaaaattttaaatttggtaaaatggcctgaacatggatgagctccctaatacctaaaacacaaagttattgttgtttcctctttgtacaaaattgcaacttgtgcagttggtttttttctctaaaattctgcatatttttggaagttgatgtcagtccgtgagtgtcacttgttacacaagcaagggaagaactttcatcaggccctcagtttccaagagcacagtcatttgcagccataaattccaagaaaataaaacaaagtagaattcaaaaggagttcaggcagtgaatcctaatgcccaagatgtcaaacctctctaatctttcctactcgtatattgattagcaaagggtctttttccaagacccttttcttttacactggagaaataacggctagatccttgccaagtggccaaaggagatttgattttctatttttcactgggaggaggtgaggggatgacagctccccattgttcctctcactcagagcctggggcctgagcctggttttccaaaaggcctgtacagtactttcaccccactggcaaatgccaatatgcagtgggttcagaatgatgaggaaaaccagacacagacatggacccagtcaataagcagcatttcacacacagtgaccactagctagtaaaatttctatgaaagaactcatatgtaatcacattaaaaaacaggaacgaggcccaagcacaatgccatcctactctgtgaagttataaaaattttatacatgcattctgaaaccaaacaaaactagaacagaaagcaaactttattacacatgctttgatctttctctaaaagaatctaggctgggtgaggtggctcatggctataatcccagcattttgggaggccgaggcaggcggatcacgagttcaagagatggagatcatcctggctaacacagtgaaaccccgtctctactaaatatacaaaaaattagccaggcgtggtggcacacaactgtagtcccagctactcaggaggctgaggcaggagaatcacttgaacccaggaggcacaggtttgcagtcagctgagatcgccccactgcactccagcctggtgacagagcgagactccatctcataaaaaaagaatctaaaattgtccccccccaaagcactctaaaataaataacaaagaaagcactataaaatcactaatgagtatagccaggtccaatatagaaataaacactatataggctaggcttctaaaaaaaagactatgaaattgaagggaaaatttattaattcaacagagatagcatttttatgaggaattttctagtggcattttagatatgactggttgttacattgtaataagtccaccttttaggaattaatatacatcaatttttaaataataagttgctcaaaatgttagtattgttgaccaaaattaagactgttgaggtttgataatggtttgataaacatttgttcgaaatcaaacgtgacgattgacaaaggtttattgaaaactaaatgtgaagattgactcaggaagtcaacagaagttgggtgtgttccagagtcagctaggagttggaaggcctctataagaaagtttagaaggaagagaactcctcacaccagagctgtcctttttcattggagggtacattacagaagttacaatcattggctacagatggcaacatacaggttaaagtgtccatgtgcaagaccatcagccagactttcttcccattctgaaacaaatcaggatccttttcagtgtctgtaagttacatagtaaacagtatgccaacaattggagaactcctgataagaccctacccagggaccgcatgttgccatgaatcacaagacttctgccagatgggttaatttggaagcctgccagatctgacccataggttatcagtattgtgcttatttacgtattagaataaaagcaagaaatttatgtttgagaaaatcatgtcatgtttcttttatagtttaaaaattctacaaaattcctgacctttaaaaaatgtatcagacttgtttttgcactgttcacatatgtgttaataataaaggttggatttatttgggagaataataaaattatattcatttgtttaattctcttcatggtatgttgctttatagttcataaaatgctttcacattttctcagttacttttgagaaaagaggaaagcagaacagatatgatactatccttattttatagataaagaaataggaattttgccacagccctcaagttaacagggctgataaaaagtgacattaaaaatatattcacatatagataaaattttaaatacaagaaattcagcttaatgtaagttattacattaatttcttgattagagtatccatgtcacagctcttattgaaaacaaatgtcataaatttagcatatgttacttaataacaaaaatattcaaaatgaatgtgattgtggttaactttatcatttctccaaagaaaaggtttccttgactacaaacatggaaaagatgaaactagaatcactaatgttgttttcagttctaatattcatgagtctacaaattttataattctttatagagtaaagttacaaccctgcacttccagtaaaacactctctttgcacctctgcctatacataagtcactctttcaccaacctacaaaaagtattctcggccgggcgcggtggctcacgcctgtaatcccagcactttgggaggccgaggcgggtggatcatgaggtcaggagatcgagaccattctggctaacccagtgaaaccccgtctctattaaaaatacaaaaaattagccgggcgtggtggcaggcgcctgtagtcccagctactagggaggctgaggcaggagaatggcgcgaatccgggagctggagcttgcagtgagccgagatcgcgccactgcactccagcctgggcgacagagtgagactctgtctcaaaaaaaaaaaaaaaaaaaagtattctatttgaggtcttgcttttgggggaaacacttgcatgcaaaaagctttctccaatgagaaaggcaagggagataggttacactgttttgcaagaagagagtgtgtgtgtttgcaggaggaaattaacgtagcagtgatctttcccttccaattatgcatgattcagcgattacacataagaagaaattcccttgcccatcttatcctgagtgaaccttgttctttcttacaaaactgagtctattttctttcatatctgttattccacaaacactgacttcacacctactctgggaagtcaccccactgcacactggggatacaacagcaaggacagaggtaggtttactctcctactaaatcttatctctattacttcacgtcattggaaattatgggtatcttgtgatgttctggactctaaaatgtcagagacatgtgaatgaaggagcgaaacgtggtgatcctcaaagcctgtaggagaagtgggagaggagagagtgggaggctgtcttcacgtttgcggcattgttctgtctccatctattgccaagggccagtagaggtcagaatattcttagcagattattgacttctgattatttgattaatcaatgatagaaactgttgtccatttgtcgatttgtaccgttgctcagtgaagttatcatagtaaagttatagtactgtatagttatgcgccataagagtaacagtgctctgacctccctcgttcacacctgggcaaggcctcccccgagacccattaacggcacaactgcgtccctagtggccattcccagaactgcaggggagggaagggaccatagaaaattctcagcttcgacgcttgcccatttcctccactaatttttatttttatttatttatttattttttgagacagagtttcactcttgttgcccaggctggagtgcaatggtgcaatctctgctcaccgcaacctccgcctcccgtattcaagcgattctcctacctcagcctcccgtgtagctggtattacaggcacgtgccaccacgccctgctaatttgttgtatttttagtagagacggtgtttctccatgttggtcaggctggtcttgaactcccgacctcgggtaatccgcccgccttggcctcccaaagtgctgggattcttacatcgactgcatagaaagaggagagaacataacctacctaccccgtacatacttcagcccaggtcctgtgcctcatctgtaatatgaatgaagagacatggagaacagaaaagaaaaaaagaaaggaaaatctatcttgggaacaacaacaacaaaatctaagaacacaactatgcatatatgtcttagtctgtttggtgctgctgtaagggaatacatgaggctggataatttacaaagaaaagattgatttggcttatggttctgtaggttgtacaagaagcatggcaccaacatctgcttctggtgagtgcctcagggagcttcaaatcatggtggaaggtgaaaagggagcaggtgggtcacccaaccagagaaggagcaagagtgatggcaggaagtgtcaggctctcttaaatagccagctcttgcataaactagtagaaaaagaactcgctcattatcacagggacggcaccaagctatacatgaggaatctttccccatgacccaaacaccttccactatgccccaccttcaacattaggggccaaatttcaatatgagatttgtagggacaaatatccaaactatgtcaacatggtgttgaatgaatggacagaataaaagcaaaataacatattagagagagaatttaaaaataaaaaaactgtatgtaacaacaacaacaacaacaaaaacaagtgaagtcaaaaatagtcaaaataccctccaggcaccagatcacagattgggacagaaaacagaaaggcacttcattaattttcaaggctttgcactcaaaactgctacataagcaatgcagtgacagattgcatacagaattcataaggaacctccaaggccatttgtgtgatcaggacagacaacctgggcatgaacttgaaggcacacatttttcgtcaaaaatgtgccaaaatgaaagcaacctcccaaaacaatttaagagaaacagtggcaagtgcaaagaaaactggacaggtatggtgaaccctactccttattcccaaagaagtataggaaagctgttgcagagccctgcatgctcaatttacaattcctggatcaacgtttttccaccctgttttcactgagccagggagccatccaatgcttcatcatcccagggaaaatgaacaaggccatcttattaattggactacatcaccctttttcctcttaaaacagggctcactgttagaaactcacactggattagcgagaaaatgctccaggcttcaacttagcacatcagaaagtcagagcttaactcctaatttaaaataaaccctgtatttttggttgttttcctttttgacattgcataaaatggattatgcaataaatagcagacagactattcacgttgcaccagtgcatattctaatgttctgcagcaacatctaatggtgtaaataagatgaaaaaactaacgatcctttatgaaagattttttttctttatggggcataatagcatgcacaaatggaccctgcagaacaatttgctttcattccttattttcgctcttatactagtaaatgtgggataaatgtataatgtctgttaaacattcataattattaaaccatcaacggagcttatcaaatcccacatattcctctccaatgagctctttaaagggaacaactttgatttagagtataaagatgtggaatgggtcagctgatcattctggccccaaactgcggcaagggtgttgtcttggaaggaaaaggaaaagctaaactaatgcagcctatagcttgtgacgaaaggacatttttcaaattttcagaagcgaagttaagaaaagattacttagaaactggcactgcttaaaaatattggtacatcagtaaaggctacttcttatttcagaatattagtagggtaattcctactataatctgaaaactaaagaagtatacatttacaagtgttgacgttccagattttcaaaaagactgcgaattcatttaagaaaaaataaaaataacttttgcacactgctccttttccttgaaaaagagtttttgcctaaagctatagactacattaacttattgttttgaaaaaaatatataaacgaaggaacagttatacgaatagtacagtaactgtagcataccttccacttccactcaccacttgataacaagttgcctcattttctccactgctttccctttctctcattctaatgaaaacacttattgttactgctgaacaattggagagtaaactgcatacatgatgtctctttctccccaaaggtttcaacattatcttctgagaacaaggacagtcttttatacaaccacggaacggtgatcaatttcagaaaaaaattaaaatttaactgtgatggtctttgattttaagaacttagaggagtgttgtaaaactccaattgaaggtaaaaatactcttaaaaattgcagtcttttctgactcctcactcaaaacaaagtaaaagcctcatgagggcaaagattcaactttattcccgggtgcacaagccctcccaggagagcttcacactcagcgcactcgtaggcaatgttaactgatttcaaaaattattcttcaaacaatatttaattattatgaagtatctcatgtgtctagtataatacatgaaatcattcttgactatgtttaacgtcaagaaggttgttatgacccacattcttgggaacatgatatactttttaaaggactctacaaaactttctttttttttcatagataaccctcaaagattcacctaactcttgactaattttgaaatatgttctgcatgtgtgccactaatttggattttaacatccagtggtagcgtctaatgataaggtagttcacatttcagactgattaaaggatcatttaataattttattcttttatctcccccaccatacacacacacacacacaaatctttcaaaagaaaaccaagcactctctccaaactgacctctattaaaattaatttttttaataactgcttggttttatcactacttccccaaatgctaattaattctaactctaaactatgtaattataatacttctgctgaaatacaaattatctggtgcccctggggtgaacaagtaagaatgtatttcatgttccattcaacagaggaaatgcgatgtttctcagaccatggaaacaatgtagcagcctccctggctcccctcccccaaaacactggcagttcctgtttcttcctctttagcaggaagacaggaacagagttgacagttggcatccagtcagtttaatgcctctctccatggggctgtgaggaacggtggcatgcccagttatttttggccaggcacggcaacacacagagccttgaggagccttcatttaggcagtggcggccaatgtacctgcagaatgtgaattgacgttgccatggaaatagaacaactcttcccggttctgtcaaaatgcatctctatctgcgactaggcagaggtcaggaaggagagaaacacaagtgccagggagaacattcgagaagggaaggactctgcagtgccccagtgtgggagaaatttgatgggctttttctgataacattcatatacactattgtgtttcaaatctggatcttgtttattcattagacagtagcaaatccggatacacacacatgcgcacacacacaccatatatatatatatatatacacacacacacatataccttatatatttatatatacatattcaccttactctctgtaaatatacatatattatatatatacatatatatacaccatatatataccttacatactaacatatgtatatatatatataccttatatactctgtgtatatatatacatatgttacatatatatgcactcacatatatacccccacacataccttatgtgtatatatatataccttatatatttacatataaatacaaatgtacctattcacctcatatacgctctctctgcatatacatatatatgcacacatatatatgcatccacacacacaccttatgtgtgtatatatataccttatatatttatatttgtgtatttatatatttatatataaatgcaaatgtacatattcaccttatatactctctctgtatatacatatatatatacacacacacatatacccacatacacacatctatacacacacacaagcaacacacacacacacacacacacacacacacacagacacgcatattttcttctgggacccaaagccagcctttgcagcctaccatataacattgttagggtctcatttttctcagttttcacacaaggttgactcaggtaatctctaagccctccttttctaatatgtctatgatgccatttaacattctgttttcagtcttaatgtgcatttagcccattctacctggaacttcaacaaaaccatgaaaacaggacagtgcatgtcataagaacacataaataggagctgtgtaaaaaaccaaagtgcttcctctctgatcccctctttggaatgtagttctggggtgctgctgtgggcactgagacctgcagctgtccctaggcttaactcttgaggtggcaggaggaaagtgacagtgctgtgtccctggcagactctcattactggaaatttgttgctgctgcctgttcctgagttcagcctgggtccagcccagtgctctcatttttcatcacctgtttggccctgcacatggctctgagtatgagctttagcccaaatgccaacctctgggtcccatgcttttctggcctctgcagactcttggttcacagagacatgggtgcttcatgcagagggtgggcacaccttgggtccagggacacaggggaccaaggagggcacatagaacctccatgatgggtattagtgaacctcgatactgagtattcctaaacacagagtgaatagccgatattccaattcaataggaatctgtgtgtgcattccaatggacccttgagttctgaccatttgcaagagaccctgaaggcctgagatgcgtcctgtcttgctgggtgaggcacaagcccagtcatctgctgacatgtggcagccagtctgtcaaagagcctcgcagaccatctgcacatattttcaatgcagtttgcccatatatatatataatatatatataatatattatatatattatgtaatatatattatatatattatatatattatataaattatatatattatatattatatataatatatataatatatattttatatatatattatatattatatatataatatatataatatatattttatatatatatatgtacacacacatatacacacacacatatatacatacacacacatatacacacacacatatatacatacacacacatatatatacatacacacacatatatacatgtatatatgtgtatatatatgtgtatgtgtgtgtatgtatatatatgtatatatatatacacacacaccacctaaaaccttaaaattttacttcattgagttataggaagaacatccatccatcatgatacaactgtgcatggcttaacagtgggatatgttctgataagtatgtcattaggcaatttcattatcatgcaaacaccacagagtgtgcttaatgcaaacctagatggcataacctactacacacctaggctttactgtgtagcctattgctcctaagctactaacccatacagcatgttactgcataaatattgtaggtaattggaacataatgttaagtacttcatttctaaatataccaagcataaaagtggtacaataaaatgcggtattataatcttatgggactactgtcatacatgtagtccgatgttgactgaaatgtcactatgtggtacataactgtatttatgaatctggtaattcaagaaaatgtccagatagccctttattttactcttcctaggcatgtgtaaatatatgacggtgagtgttatgtgtgagcttggctaggctgtaataatacccagttatttcatcaaacacgaatctgggtattgctgtgaaggtgttttgtagatatggttaacatctacaatccagtcaattgagaaccttatgaaaaaaagtctcagtgctatggtctgaattattgtatctgcccaaaatttgtgttgaaattcttacccacaaggtaatggtattaggaggtggggatttgagagccctcatgaacggtattgtgcactcttaaaagacacctgagagagaccccttgcccctttggccatctgaggataaagcaagaaggcgctgtctatgaaccagggagtgggtcctcaacagatactggatgtgctggtgccttattcttggatttttcagcctccagtagtgtgaggaagaaatttctattgtttacaagccacccagtttatggtatttttgctgtgacagcccaaatagactaagacacccagaggagaaattgtgactcaagaccataacataaaaatagaaatcattcttgagcttccagcctcttgctttgccctacagattacagacatgccagctcgacaattgtgtgggccaatttctttaagtctctgtctctctcactctctctctctctctgtgtgtgtgtatgcgtgtgtgtgtgtgtccatacacatataaaataccctgttgattattggttctaggtaacttgaatcactagggtagtttaaatcaaatcataaaacacatgaccttccttcttataacattctagactctaaaatttgttgcccctgactcttaatataagcacatatttatattatttcagatcttgcatctattagaaggcatttaacaactctaaatgaatatgtttccttaatgacataattcatttgccctaaattatatgtgaagtagattagcttgcaatagtggaataaattgctcctagaataaattctaggagccataaaactacaaacttccagttgaattttggtggtatacttacttgctctcattctagaggcacacaggtcagtagttataccttactttaaataccatctttcttcaagagaaaataattctctgcaataattatagcaagtcagttaagaggagcaggattcaatgcaatgctattatcttccagaaaatatgcttttcatgaaagtatttcaaaatcaaagattgctgtcaacaatttaaatgcattaaatatttttatattttatagattcttgaggaggaaataaaacacaaacactaacgtgagaatggatgaaaagttatgtagtgtgtggccgggcacggtggctcacacctgtaatcccagcactttgggaggccgaggcgggcagatcacgagatcaggagttcgagaccagcctggccaacatggtgaaaccccatctctattaaaaataaaaaaattagccgggcatggtggtgtgtgcctgtagtcccagctactcaggaggctgaggcaggagaatcgcttgaacctggaaggtggaggttgcagtgagccgagattgtgccactgcactccagcctgggtgacagaacaagactctctctctctaaaaataaataaataaatagaaaatatatgtagtgtgatgtagtgtgtatataaggaattgcaaatcattgtatttgagttagcacatgagaattgagcttaaatggcctttgcttgtttgcttaaaaatatcacatgtaccctgtaagtatgtacaaatattatgtattgctaaaaatttaaaaatactttcatagattctaataaaataaaatttcaaacaacttaaaagcactctttctgtgttttacaataattcaagaatccctactgtatgtagaacagtgtttctcaaccggggtcatttttgaccttctgatgacatttggtaatgcctggagacattctttgttgtcacaactgggagtgagagggtgggtggtactgacatctagtgggtggaggccagggataatgctaaacatcttaaaatacacaggacatttcctttggatgtacactcaggagtgaaagtactggatcatatggtaggtccacttttagttttttgagaaaccgctatacttttttccgtaatggctttactaatttttattcccacccacagtgtgtaagggtttcctttctccacatcctcagcaacccttgttatcttattatgtcttttggataatagccattctaactgaagtgaggtgatacctcattgtggtttggatttgcatttatctgatgattagtgatgctgagaatgttttcatatacctgttgtccatttgtatatcttctttttaattttttttgctgtctttttgctgttgacctgtttgagttccttatgtattctgaatattaacccctcaaataccacgttttcactcatatgtgaaatctaaagtcaatcttataaaaatagtgaatagaatggggtaaggagtaggaatagggagatggggagtggagggtcaatgggtacaaagttaacgatgagaaaggagaagtgctggcgttctgttgcacagtctggcaactacagtcaacaacaaggtacgcacatctcaaaatagctgtcatagaggattttgtatgttccccagaaagaaatgataaatgtctgaggtgatggatatgctaattatcctgatttgatcattaaacaacgtatacacgtttcaaaacattacgttgtgccccataaataggtacaataattgtgtgtcaattaaactttttaaaaaatatatttaaaaatgcataggacagttcgccactccctccccgagaaaaagaattattttgcccaaaatgtcaatgggttgaggttgagaaactctgctataggacaaagctaggcataaggtatgtgtttcccattggcatgtgccgtattaaggagtgagatagaaatctttattaaagtaaggccaatataagcagttagtagacagaaacccagtacaaactcagagtaaatggtgttgttctccttaggagaagagctaagcaaacaaagcccatttcagctcagttaccatgtgctgacacaaatccacaacaagggataatagcaaagcaattcgttccacttgattatagttcattttgctcaacaggaaagtcagatttgatgttcatgatcatcaggcataaatcctacaaaatgtatttaataagaatgcaatgtatttttaactgccttcattaatttgattgtcccccctttaaaacaataaataatgactaaatctaggtcacgttttctctttgggccttggctcctcagtttcaaaagtggagagttctactctgtgagtcctttagttcatgaatccttgctgatgcaggatacatatttttttccttgaaagggaaacagaattgatcagctgataggtgtgatcgtcatgagcaaaacaaacttcgctttaagaagttatcaaatctctgtatctaaagagaattttcgtcaagagttttcgagattcagatgccaaatcttcctgtttccattcgcaactccatcaactctatcttgccaccttgctgcccagagttgaaagcagcctggtactcagggcagggaaggcagaagcacatgtaattgtcacatgcggtaggaatcaataatcgacaacataatgacattcaatgaacaatttacactgaaggtaaataaattgttgatttcatgtttcgcttacacatagtgcaaagagctcttcaccacggctctggtgatgaaggctttgtatttattaattttgttgaccttggagaaataactttactcctctattggagtttcctattgagtaatgctggcagacacctagacacttcataattttaaaaaatgcatactttctaattaatgaaggaatagtgatacagaagcgggcagggaagtgttgggtagaggaggttgtggtccctgactagggctctactcccaggcctgtgcccacggacctaggtgaaggcagacatttctgtttttgtgcccaaatattgcaattcccaagaccaccctggcctgccatgcccccatcctgtgcctataaaaaccccgagactctagcgggcacgcacacaagcagctggatgttgagaggaacacatcagtggaaaaagacacaagtggctggacttcgggaggaatgcaccggcctaagagcacaccgacagaagccagcaggccagcaggccattgaccggtgaatgccgcagagtttcggggaggcagagggaggagagccctggtggctgagcggcccaactccaggggaaaaccaccttaccactccatctcccttctggctcccccatctgctgagagcttcttccactcaacaaaaccttgcactcattctccaagcccaggtgtgatctgattcttctggtacagcaaagcaagaaatcctgggatacagaaaagccctctgtctttgtgataaggcaggagtctaattgatctgatacgcacaagccacctgcacatgctaaaccaatagagcacacagtaacacacaaacacacacacacacacacactggggcctcaggagctgtaaacattcacctctagacgctgccatggggtcggagtcaccacagcctgcctgtctgtatgccctctcctgaaagtttgagcagtgaggcaccgaaaacacgagccacacccccatcacacaccctgagagggggacaaagggacttttcccatttcaacagtatcttaagaacttgagtgaatgtgtgagcttgatttgatgaaagaaattcggcttataacaaaaaatgccagtagctaccatttaaacaatcttagtggcagttgggtccttaagaaaatttatttatttatttattttaaacaaccagatctcatgagagctaagaaaatttagatcatgagcaacttaaagttagaattttcatgaacaaatttttcaaaattttaatctgtcattttccaatctaatagcacataaaaatctaaaatttggaaaattaacagattttccgaaacctttatttttcgttaatgagagaacaccacaggataattctcttttttttccttttctatgtttttatttttaaacttgtcctttttctttgcttgataaagtaatttaaaatattagatattccttaaaaggttgaatagaaaaagttatattacataaaatcttaagtgcttatatacatatataaacactttacatagagttaagatttttcagcgctttctgtgttatcatgtattaacaatcaatacaaactcttggtacacatgtctgctaaacatagaatctggacaagtcaactaattcattctttttttgcttgagttttctggtcaagaatgactttataatagactcagggaaaactttttttaaaaagtagagaaagacaaattctttttgggaaatgcagtattaaaaaattcacagggccaggtgtggtggctcatagctgtaatcccagcattttgggaggacgaggtgggcggatcatgaggtcaggagttcaagacaagcctgaccaacatggtgaaaccctgtctctactaaaaaatacaaaaattagccaggcgtggtggcatgcacctataatcccagctactcaggagactgaggcaggagaattgcttgaacccgggaggtggaggttgcagtgagccaaggtcatgccactgcattccagcctgggcaacagagtgagactcagtctcaaaaaaaaaaaaaaaaaaaaaatccattcacagaagactgtgaaattcaaatacattattttcaattcccatgacatttacaccagtgatatgctagaaagatttcagaaaggctcatcataactttataaataaatctgttcatactacttgtgtttttacatactgttgagtcccaaaagtggattttatttgtgacgtatttaattcatggcaagtatatacatataatacagcattacataaatatacttggaaacaacaaaaactaaacttgaaaatgatgccattcctccagtttttggagaatgaggcatgtcttcctcttttctgtctagcagtggacagtggtatagtcagaaccaggttaaaacagatgtggtcagggaccaaaagagtgtgtgtgagggccctgtaagcagctacaccacgggggttcatcatacaaagtgggtctttgtgttacagatctccaatgtcatgaaacaaacattctttaagtgagaagaacaattatacattgctgataaacacttccgtgaatgtatcaaatgatttgctaagatattaaaactagtaacttttcagagtaatttggtttccatcaagaagccttctgtgcaaggaggaaatagccactctcaatgtcttggatccaagaaactacttatttgtcaccattttctcttttctcctgttaaagaacaaggactttaaaattagacagactcagctcccagctatatggtctcagaaaattcacttaatgttttgaggtaccctcatttcagtctcagccaagagggctcctactgaaaacccctgtggccttccatctgagaaccttctcttggccagcaaacaagacagagcatgaacagacctcagccatagataaggtgggctcctggtatctcagacatgatcatttgaagtgtactgtaccaaatctctcgggggccccaggtgggactgaaccccagtttcccacaccaataaactgctggacaacaccctctctactgacttcttttctttcccatgtccgttccccaatttcctaggatactttctgggcctgcctctgaaagaagttccttacactcaaattcttgtctaggatcttgcttctcggggagcccagcgtcagaggctcccatcaacctcccagctggagctggcccccagaggcagagctataactctgcctccagctgggtggttcacacctaaaccctctgagcactttgcagaacttagtttttttcagggcaagtacttagcagagaggagaaggtgggaatattgttcatgccttgtttgtgacttaccacaaggccaagcctttcagggacatgtcactccctcaaatgaaacccacttttatttggcttattcagggagaagggggtgaaggctactcagagggctccatccaagccttaactgacacaggtgctgcaatgagaatatgaaactggatgccttccccttttcaggtgtgtagaagacaaggacatctgccaaaagaggatggggtgagagatggcatggtaggtgaggccggggggtgggattcagggagataatgagagccctcgaggtaacttcgggctggccaggaactttgcttatcagatttttgcagcagtttgaagagaaccattagggcacttcaacagaggcctgaatacattagttagcttgattgtggcactcagttcacagtatatacatatatcaaaacattgtgttatataatttaaatacagagcacttttatttgtcaaaatcaattagttaattaagaaaaaaaaaacagagctctggatttgatcctgagtcactttctcagtggtacaaaatatgctggcaggggagctatttctaagaatgatgctcagagctttggagccaggaggtcaaggtgcttccctggcctgtgttcctgagcccctgcaaagttagcagcatttgcactgcctggtgtggcttaaagtccctgccctgctgttccatccctctgatctttccaagcaggtggctctggcctctgtgtctctttagggcatttgctctgttaagctccatttttctctgaccttcctattcctgatagtgtccctatatggacatacaggtgaagctctcacttcctaaatgcttccagccacactgccttcagacaaaatctaccccatgtatggtagatgccaaaaatagccataatcctccatgtctccaagtatcatagcctttacaatgatcttcacaactcctcctatcaagtcccatagtcttcttctccactctagccacatggggcatctttgtatttcacattggcccacagaatgtgaaagaagttgctgtgtaccagcactgagtctaagcttctgcacactctctctctgaaacctactgagctaccatgtgaggtagtctagggttgcctgctggacaacaggaaacaatgatccagttctccttatcttcctaacacatagctggcaaccaaccccaggagaagagccacctctctgacaggcagctgctcataaactcatgactgaacctagctgacagcagaagaaccacccaactgagctcagcctaaattgccagttcacacaatcatgaactagacaaatagccattgttctaagccactaagttttgaagtagtttgttatacagtaataaataacagatacaccctggaataaatccagtataattatattgcagtgcctgtttctgctgtcattgctactggtgcaaaggaaacatgaagctcacccttgcctctggaggaagaaccgtgggtgaaatcctgagacagaaaccctgtatgcggctctccttttatctgaagaccacccgcctcatagctgtggaaacaggagcggatgctctaatcatgccactagtcatctccaggagttctgccatgtaaggtaacctggtctggctgccatccatcatctctgtgtctcaaaatatcacagctcctttttaaacctcaaagccaaaaagcaaacctttcaacactggggtggttcagtgcccaaaaccatagtatttctaccatgttctgatgatgacttcataaatcatcattgatttaatttcacaaagctctccatgacataagcacagccatagccacagtcctgacccatatttaatggtgaaattcaagaatctactatgtgttgggattctcctctttcctcctctgtgtggctcaaataaggcataagagacacaaagcgagattcatcatattaacttaaggaataaagtggcttcctctgagaacttggcctccagttctcataatatactatattatactccattatagtaattactggcctgttattttgttatacattattatacatagagtgtgtagaaatgttttataaatagaataatgcatagccattgccctgaattttctagaacagcactaatttaaaatattccttccagtaaatactggatattgctcttccttgagccaagaatttcttctacttcaatcgtcatgtctgtgacatttgctagcaccatagtctcatactgttggtaaattttgtacaagtgcatcttgtctttctaactaactggtctattccttaaggtcacaagccttgagggatggctttatacgtccctactcctccactgccaggtactccatctgtcctttgtttttgctcagttggcctcagtaactcacctgctaagtcattgtctctgctttcagaatcctagaggataaaagacagagcagcagccagcgaggtgagcagcagtcagagcctcctcatggacaggatgaaagacacattttgtctttggcaatgtccaggctttccactttttttttttttttttttttttgagatggagtctcactctgtcgcccaggctggagtgcagtggtgcaatctcggctcactgcaacctctgcctcctgggttcaatcaattctcctgcctcagcctcctgagtagctgggactacaggcgcgtgccaccacccccggctaatttttttgtatttttagtagagatgggatttcactgtattagccaggatggtctcgatctcctgacctcgtgatccgccctcctcagcctcccaaaattacagacataagccactgcttctggcctaggctttccatttttagcccctcctcttcctcaaagcattccatggcactcccctctgggaagtttctccagtaaggcagtgatcactgtgctctccagtgctaagaggcgctggcatgcatctgccattggttttacatgttactattacaaaacagggtgctgtttcttagtggccgttaaatagttttacctttgcacaggaatcatatttgcactattagcttgtgtttattaggagcaaccttaactgcaaagtcttggatccttacaatgtgtttcaaaagcacatggacctccttcatagttggtatggagcagatcaaaggtctgcatcccatcctcagagactcacagtcccttctgcttgtcaaaggatattgcaccatcatgtccctcatatcagcacctgcctggaccataatatgattggatgagaaatgttcaaggtaaatttttaagtatttttagctctttccatataagaatgttccagacgtgactttgagtttggaagaatgtacataaccaccttcagaacctccttttctttttagatgaaatctcttttattataaaatatcagagaattagcataactcttggctatctatccctcgggtatccctctttctttcctttctgcaagaaaagcaaaactaagaacctttatttacttagaaagtcagttacaggaggcaataaagtttatgggaacaggcttgtcgttgcttatttcccattgaccccagcaatactttggagaaacaatttctatgtcacagatatattgctttaactctaagggtgctgtttatttcaagagatgccttaacatgatgaaataataagaactgaacaccttatacaattgccctgggctcacatctcagttgctctctgctgtagctccacactgcccccagaagtgacttgtccaaaccaagtgcaccattccatggtcattgtacgacagacacaaactcagtacaaagaaacaccattgactcctcctgatttggttttctttttagaataattttcttacccaggaactgaaactccatttattgtttaagtcacatacagatttgataagctctcttttctcaatttgacttttgttgataaacaaaactacaggttaaaaaaagtttttaaatattcacaaaaaataattttcagcccttcagttgactggttgtctacaagttgtcttttgggagctctgataacaggtggtgtcttgaactgagtttacactgaaagtaaatgctctatcccattctgtgtcatgataagacaattctgagcaattgcatatccaccctatagaaagactcaagtgcttggctaatttaaaatgacaaataacctaaaataagttctatttgacattaaaatgctctaagaaaatattttttctcatctatagagacagttttcctctcacttggaaatcccaggacacttcagaatccacctatggaataccaaaccaccctttctccaccctaaacccacatttcctcaggcccctcctagagccacagtttccaccacccaccccatcgctcgataagggagtcacaacatcctccctgttttcttcactctgtccacatccgtggtgtccatcaaagctacatgcctctttgccataacatctctcagccctgcctgtccatccatccatccatccatccatccatccatccattcaaccatccatccatccatccatccatccatccatccatccatccaaccatccattcaggcttccctagactcccctcgactgaactatgtacaaggagtgccctgcttctggtgttggtcagcctcgttcccacgactattttccacacctcaggcagaataagagtttacactgaaaacgtgattgtctctctccagctacaatctccttcttggcgtctcgtcaacaccagcagagccaaaaccaccaaggcttgcaggacatggtggtttacagttcctgctggcacctgcagcttgccttttgcctggaatctgcctccctctccccaaggctgctgccggtctcaggcgcattatgcaccctctgggatcaggttccctctgctgggtacaccgttccagccaccacacctgtctcattcttcattcacccctgtctccgtttacctgtcctttcttatagccacatgcccaagctcctgcacggtccttctccagcacccagcacaccccagggtcccacagtagccttgggtgtgtttcccctctgcactgcagactgatgggcagggaccacgtcagtatttccaccactgggcccagctcccggctcagagaggcagctgctcagtgagcttgctcagggcaagggtgaaggaagaacagagcagattccaacaggaaattccaacccagagctctcagctcagccttaaggaaggaggagagatgggcaaaaaggtttggtccccattcctgagtggttgcatcacaggtgggtggcatgcagcacattccctgccatcaaaacacaaatcttgtcatggaaaatgcaggtcttgcccccattcctttccttcttttgcagcagaaattcaattaaactgataaatcagcaaccagtgatatttggcaggttctgcatccagcatcccactcaatgctctgcacagctgtctattgtgggtgtcactttgaagatgaggtgctgggcttggggaggacacacagtgggtccagcgacatgtgggtggcctcaagtaggcagagctggggtctgaccacctcccagattccaaagcctcatcatttaaggagctgcaatctgttcaaagtaaatattttcaaaagactcaagagttcttactttttgctttgatacactcttcttttatgctctcacggctgcttaaaaggtcatacaaattaaatggctttaaatcaatgttatgatttaatactttatataaaagagggtgcttaaaatactttatacaaagaaattcctttaaaattcaaaccactggggaaaacaaaaaaagaacaatgaatctgaaatactaataaatatcagataagacagttgctgacgtcaagttaaaaaaataaataaaagatccatctttttcctccttgcagattgatttccctgaactattttgtgacagaatcacttcaagtctaggtgtctgagatgcctcactgaatgagcagacaacatgaatgttctagacacatggaaggcaagcaaaaaacaacacataaataagcaagcatggggtatgtgcagcggtaatgaaagctatagggaaacataaaggaaaggtggtcagaaatgtctcatgcaggtcatgatttatatgtagtgttcagacagttcttgccgagggctttagctcagtggtccggaacaagaaagcaagcagggaaagaagatcatgggtgatgggggcatgctgctgatataagatggccaagggcatcctgatgaggggacataagtacagagactcaaaggaaagagcaagagagcctggggtaacctgggggagagagagcatggggtgacctggagaagagagaacttggggttagagaaacctgcaaatggaatggccctgggtaggactttggcgggggtggtgcttcaaaacagccacaaggctctgtgtgtgtgtgtgtgtgtgtgtgtgtgtgtgtgtgtgtgtgcacacgcacgcgcatgtgcgcatatgtgcttttgggcatttcacagggccccagggaccaccgtgacagcctcagtgagggatggcacagtcatccgaagcctggacagacgtgggttaaaataaagtcacttaattgaattaactttacaagttcaatggaaaaatgtttcacttgcagttagtcagcaaaagcagggaatctgagtgaaaagggattctgtaggtcctaagattgtttcaggatactgtaaagagaataaacgctacctcattgtcttggcttaaaaataatcaaaactatccttacctcctgccaatgtgtgtgatgaatccaggcatgtgtgaatgcatgtaagaataatttccttttcattgctctatatatgtacaaaatattttgcatattccaggatatatgtgaaaattgtttctttctctgatttcctaattcaagatctgatgcacaaaaccaacatataagcattgttaaaggaaatgaatccacctatctatttccccatccaaacatctatccatccatccacccatcgtccatccatccgtccgtccatccatccatccatccatccaaccagccatccatccatccatctgtccatccatccatccattcatccatccattcatccatccatccatccatccatccaaccatccatccacctgtctgtccatccatccatccatccatccaaccctccatccatctgtccatccatccatccatccattcatccatctgtccatccatccatccatccattcatccatccatccatccacccacccacccacccatctatccatccatccacccatccatccatccatccatccttccatctaaccctctgtttttctatctcttccttcctccatctaggtttgaaaatgaagcttcaaaacctatttaggtgattggaacatgtcatcactctcaatattctagcttcttcaagtggtttccctgaaaggaaatccatttgattttcttttaaataaatcttctgttactaatacctgatgtgctgcaagtatgatctcattttaaaatggccacatattttaaaatttacttgataaatctgcatctactttattcctatggaataacagaattttataaaatagaaggtaaaagctaaataccaccattctgcattaaaagtcaaaatttaaacaggcagccatatgttttttattcattgaaattaggatattcccaggttagagtatgtgaaatttttttatgaaaattgactttcataactagaatagaaaatttgaccccaggtggcaaaatcaattcagattccttttgacattttctaaccttggaatttctctaggagtaaagtagttgcataaagattatattcttggatattaattatttcaagtagtttccacagggaaaaaagtaaatgtcatttgtgacagttcagaagcaagtcaaggttttacttcctcttgtatgtaagaaagggaaaaataggaaattcgactagaaaatgtgcacatctccagggtagctgaagggagtcttcctgcacaaagggtagacttggggtgatccatgtgtgtaccccgccttgatgtggacctggagactccacaggcatgtccccagaactcttgcttcactctgcaggatgatgacatttatcaccaagtgttcatttttatgaacatatttcttgagctctgccttgaaaaacattctttacatttgaagagcaggtatcttgcttgctatccagggcaatgatatagagtgatatatttttaaaaagtaatctattatgttactcaataattttatgtaaggtaattaccccaaaataatcttctatattacttattttaatttaatctattatcaattatcctctgatttagaaataaagtacagaatgacatcaaatcatgggcggttgtaatgatttctcccaatattacctctgtaatctctaaacttacgtggtatcatctagtagtgaataagaaaaatagggggttccagcttggggcaagaggatggacttttctgatagacatacctgggtctgacttggttccccaagaggtggtcacagttaagactgtaacctttgataccaagtcactaggttttcatgctggctggccacctgctccctatctgatctgcatatttacttacattccctgtgtctaagtatcctcattcttaaaatggatacaatgacactctctatcttaaaggtgtaggggagaattaaataagataatacatatttaaagtcttagaacagtgcttcatgtgaataagcactaaaaacaaaatgttcattttctccttattataacatataataacttgagcaaataatttccctagacttatatcctcaaccataatgtcagacaaaaatgcaaacagagttagggtgtggtttaaatgtgatggcgtgtgttcagatcctggcaaatgcctgccacattgtatctcaataagccttagtttccttaactttcattcagcctttaccaatcaggatgtaagagtcacagtgtttgtcgaagttaaaaaataaattatcagcatcattcctactgtagagactcaactaactgtagatatgcaagcacatttttcaaaaatatattcatctcatttcttaatgtacattattagttgagtatcagatatgtagcaagcactgtgctacgtgcagaggagacaggatggataagagccaatccttgcccttgagaagctcaaagtcaggtgggaatgacaggcagataaatacataacatgctgaaggttggtggttgtgagactgtagagagacgcggcacctcagatacacctaaatggagcaaggtgaccaactggttcaaagatagtgagagatgtctaggtccaaccacacctgaaagtatttaaagcaggactttgtctccttgcaaggtcaacatggatcatgatttgggagaaaaaaacacctacttggttgagaagtatttataggcaagaagctggaggtaagtgctgtggccaattctcaaggcaaataaagaagcccctacaaggacacccactgcagtgcagtgttgagcctgagacgttactttacatcacatctctgaatggtgaacctcatgcctttaataaacgtaagtgtccaacattcagccagcaaatgtgcgaaaaacaatgaaagtgggcatcagcatgttcgattttatggttggagaagaagcggaaactgatttcctgtgatgccgactgggacactgttaagggttgagttgtgaccccctaaattcctatgttgaagtcctaaccccaagaacctcagaatatgaccttatatttagaggtcaggtcattacagaggtgatgtgaaaccatctaagattcaaaggttttccaatactctaccaatggattttgaaaaccaaagctgaccggtagagtctttttttttttttttttttgagacggagtctcgctgtgtcccccaggctggagtgcagtggcgccatctcggctcactgcaagctccgcctcccgggttcacgccattctcctgcctcagcctccctagtagctgggactacaggcgcccaccaccacgcctggctaatttttatttttttatttttagtagagacagggtttcaccatgttagccaggatggtctcgatctcctgacctcgtgatccgcccgccttggcctcccaaagtgcagggattacaggcgtgagccactgcacccggtcccggtagattctaatctaattcagggtgaagatttggtcttattaatttttgtaaggacataatataacggctgacacagaaatacagttttgggatgcgtaaagaggacacagaaaattttggcaatgatttctgaacttgatttaaagctctcgaattttaaaaacaagtccagccgtgacagctttgaaggccagaggcatggtgcctccttgtgcatccccagaacaggactgcctcacttaggaaatgccccttaataaatgctcctagaactgcaaaacacctaacttattccaaactttccggatgaaaaggcagaggattttctactcccatttcaggtctcagactccagctcatgacttgagaaacatctttttctctccctggctttccagaacattctcatgggccacagagatacccatgaaagtcccttagcattgagcactttgattaatttattgtttaacaacttatcaaaccctcttttcactgaacaaagttcctggaggcctactgaaatatcatatcactcagtataatttattcaatatgtggtgaggaagggaggtaggtcgagagagagacagacagacagcaggctgatttatgacatagatcggtgctgccttctcctcttgcaaacatgtccacaaatggacagcactcttgagtaactaaactctgagaaaactaacattgtttatttgtgacatctaatgcctcaagaagaaattactgggagagaatgctaccttttataggaattatattccccacccccaccaaaaaactcacatgcttaagtactaatccctagtacctctgtccttatttggaaatagggttgtcacagatgtaattaaacaaaacaaaattatagtagagtaggacgggtccttaatcctatatgcctggtgtctttataaataggagaaatttggacacagacagacacacagagagaatgccctgagatgatgaaggcagagatgaaatcaccaaacaccaaagactcccagaagctgggagagacctggaattgactctctctcagcctcagagggaaccagccctgctgactccttgatctcagaattgcagcctccagagctgtaagacaatacatttctgtcactggctgtacttccttacagcagccccaacaaaccaacgcttcccaagcacctttcgcattatatgaagtagtcctcctccttccatgtggttttggagggccctgaagtgggacccaggtggaattcatctctggatctcagagagagcgctcaataaatgctaagtggtaggtgagtgagtgagcagtggagcaagagaatgagtaaagggatggatgtagtgtttgtctgacacagaggcagagcaggggccactcagttgggtaaaggtctgcttgacagccaaataatttggggatagcctctctcccatcggtcactcactcctgagagcccttctgccctctccactcagaggtcacgtgtttgatcaagagatggggtgttagtgctccttcatttccagttgaaagagatgacagcatctgtatgaatccaaagctaaccccgtgcacagcagcacgccaagcacagcaggaagctaagcaggcccatcacgctgtcctgtaggacccggagctgttggcttcaaccaaaatgcgccactcccccaagtactttcctctaacaatcacaaagctgtgaaatgtccaagttttaaattattattgggaaatatttcatcttttgaaaacaattctggtttccccattttgacaccaagcagaatttggcccaaaactaaaagcgagcaacttttaagtatgaaatcaaaatttgccttgatattgtgctttctgtgtttgccatacaatgaattctggagcaatggtattattttactttattttaattttctgttgtgttttgtttttctttcctcccagtgtggtccttgaaccgcctgctaataaagtcatcaaggccgtggtgttcaaatcagatcttaaggcctctcaggtagaattgcttgatgagactggggaacatggagcacaagggaggggaaggaggagagaagaaagacaatgatacatttctgctctaatttattattcggggtctcagacacaatgaagggcaatacctagttctctgggttccgtctttccttcatgaggtcaagtagtagaggatgaaacagcacaaaggaaaatcaactcgtaaaatgaagagaaaaacgtgtcctttagaggatgaaaagaaacccagacagagactttcatagaacaaaacttgggactaggatggaacctcgctgaccacagcccagtgattacttaagggagtcccatgttttacagacaagctttaggggtctccatgggacaagcttgtggttggggaggccgagagggcccagaccccagatgtccacaccgggtccaccagagcatcgctgagatttgttagaaaaattgggatttccatggctgggcgcggtggctcacgctggtaatcccagcactttgggaggctgaggcgggcggatcacgaggtcaggagattgagaccatggtgcaacgccgtcgtctctactaaaaatacaaaaaattagccgggcatggtggcaggcgcctgtagtcccagctactcggagaggctgaggcaggagaatggcgtgaacccgggaggcagagcttgcagtgaccccagattgtgtcactgcactccagcctgggcgacagagcgagactccatctcaaaaaaaagaaaaagaaaaaaaaaagaaaaattgggatttccagtgaaattttatttgagaaaaggagtttatttcttaaaaacaagtgtgaaagcctgtttgcaaacagaatcagtgaaatgaaatacagctaaaatcacttataatcagggacagatcaagagcaaggatgttttttgttgttggtcctgtgtatctctgtttcttataagatgagaagggatattatgatgttattaattgaaaaaaagacaattcctgagatttttgaaaagggaaaatatggaccagataccttcattaagatgaaagcatagtctctatatgcagataagacccagggcattcctggtgtgtctcgttttacctaatggctttattaacataaaatcattttcccatgtactcacaaatattttcacgtttctattttttcctagatgctatggaaaaatatggccaaaaaacctgtccttacttgcatagtactataatgttagtgtcgatagcctttagcagtttgtttctattgagttgcattatgcatttggggtgctttattttcacgtatgatccatctccaatatctttattagaattaatgagctcttaacacacaatgactaattatcaactgtcatgcttctgggccgttcctcctacatttgatgcccgctcacctccccttcgcacacacaacccaaaagcagaaagcaaaaaaacactctattcattaatccattcactaaacattaattaaggtccgtctagattctgaaggcaaaagttcagatcaaacaacaattcctctaagaagcctccattgatttcccagatagaaccaattcctctctcccctccgctcccacaggactcagagattctattttcacacacagcgtaatctctctgtcgatgttaattacccacatctacgtccctccatgcccctcctcacactgcgctgtgaatctctggaggatgagaagcaggttttatttgcttcctgtgttctaatgtcactaaatatggccttaattcttccacattgtaggaagcttagtgaaggaggcaacaaacaaaacttcctaggatataagagctttaaaaatataaatcagaaaaagatcggtaataaacaaacatgaacaaaagagagggggtgctgcttaggctactgggtcccgcatctcctttgctttctgccaaaatgccctaaaagagctcccccatccctcccagcctttctgtgcaaccctgatccctcttcgatcaacttcaatccgtttttaatgccattactccaccaacaaatattgagccaaccaactaacaactgagagaaaatattttattaaaaggaatcccatatatattacttttaaaggttttttgtttggggtattttttttttaaagatggggtttcgctgtgtggcccaggcatgtctcaaagttaatgagctcaagtgattaccctgctttcatccttctgagtagctgggactacaggtgcatattacaaaactaaatgttataaataaaacaataaaagtgttagaagaaaatccagttgcatatcaatataatcttgatacaggggaagtctttttatacatcaaaatactaatgaatgtcattttacaggccattgttatttttatttttgttcatttgttttctgcatattagataacataaaaattttcaataaaaaagcattcacattactataactagtccagaactttctgcaattgcctctatttcaatacttattttatgccagcctttagtaacagactatatttaaatgcttctctgaaacaagacctatgtggaaagtaagtttacaaataaaataaagtgcgtgctagtaagcatcagataatacatatttgaaacacacgagaataaacagcaaagcttaaatttaagtattttaagagaagaatcctaaacataatgctcttcataaatagttgtctgtaccatttattctggtttagtttacttcataaattgaaagttatttccttattaaaagaatagaggcctttctcagagtcaagaattttaaaatgtttaatatatcacatatatgtgtatatttgtgtgtgtgtgtggtctatacacacacataaatgcatataagtgcgtaagtatatataagacctaaggtcaacattttacaagttgtgatgtcattacatgtattaaaatgaactttaataaagtaataatattatacttaaggaagaatgatttttcagtatattgatgtttaggaagacttggaagaaatccaaccaaattcagcaaaatgtattgcactgaaagtagtagaagacaagtatttggaataaatttaaatttctatttgttttggacctggtagatgtggcaacgcctctaaaacaaaaggcattattttgggataacttgcagtcctgatgatcaaaaagaatgtcacttgcatagatcagtggctgaaagcaaagaaagaaccaagcaaaatacacaaaagagcatggagaaaaagaaataggaactcaaagttttaacaaaagaaacttgttttctgaaaacacatggcatttttgatccacttcttcattgagactatctgcctacatgttctctaactgactgatttcagaagaagattattcaaaatatatagaatgtttcaaaaaataaatactcaatctcaaaaaatgaatgttcagtgctatctatacatatcgttgggaatgacctattcaacatgaatttgaaactgtaataagagaacatttttaggggtaacgatgtcacaagaaacacatttggatgcccagcatctactctcaaatgttgtggaagttagattaatggttttcaaattgttctaattgctcattgctatggactgaaagtttgtgctccccaaaaattcatatgttgaaatcctaactcccactgtgattgtattaggaggtggggcctttggaaggtagtgaggtcgtgagggtgggaccctcaagaattggattagtgcccttagaaaagacgcaagagttagcttattcttcagctctgctctctgccatctgaggagtcaaagagaaggcactgtctgggaagcaggaagcaaggcttccccagatgacagatctgctgacaacctgatctcagacttccagcccccaaaacagtgaggaataattgtctgctgtttctaagccacccagtcttttgaactttatgattgcaacccaaaatgggctaaggtgctcattttgtcaataaggaaatgaaggcttggagcaaagtgcttaaaatcctagttattaaatatttgcaccattaaccagactccaggtcttcctagtccagcatcatgtcacaatattagaaacgaccccaggaaagagctccaggtaggtgtcctcttctgaatactggcccctcacccgggcctctgcggtggtgctgatcacactgtgtggcatttccctgaagacaatatatgctccttgagatatttatctgattcatttttaaggggaaacaatcaatgcattaaataaaatgtatctggctcatttcaaaaaagaatacagaatacatctcacatacaaaatatgtttaagtatttaaaatatttgataggctggaaaggtcagacaagtaagattcctcttccctctgacagtgtgtgtctaaatgccataaatttttaaaacctgatgtattcacctccaacaccccaaaggcctaaacattttagtcctaggaagtcctgccatttccctgattccagcaatcaattatagggatggggacaagaaatgttatgatggccactgggatccaccatttggcatccaggtggcctttagctaagtgatgaagaggacatgggcagccaggtcacagagcattggcctcatgacccagaaccagaatctggggtaggtcatgtcctatcacaagcgaccctctaggggaatgcattaagcagaatgtcaggttgaatggaaatcacacatcccttcttcacacctttattcatacctcatgggaagggggagccacagtgagtctgtggaggaaaggaatgggggggcagggatcccaaatctacaagggaaactaagtcccagcttgaggaagcctccaaaccctgtctacttggtatcagtcttccacctttacctctaaagggatatcaaattagtacttctcatgagtctctggtcacctagccgccaagcattactttagtaattttaggactgtccccaggcaacgaaagtattaaatgacaactattattattcataatctcctgtttaaaagttttatttcatataaatttacataattaaaaatatttgtaaataaaatattgctgctctcggttgtgttcattatttgtctcatctacctacccaaggggaacacttctttcactgttctttcaaaagctaactttttaactttgaaaatgcctgttccatagacagtaagtgccaagttgaactcttagtcagtgtgagttgggtttaaccaagaggatacctggaagtgaggggtgagccatcgcactggtgaaatttcctgcagcatcagcaggagtcaggagggcaggggagaagcttcataatacaggcaggtgggctgaaaataactcaccatgcagggttctagaaattgaggaataagccttggtcacggagtagaacaggaattatgggaggcagtctatgcaaagtatatgcaaatcacttggaagagtctgtcacatcggaaacttcacatgaatagcagctgtactaagttgagcggtgtcaccccaaaattaagaaagtcctctggaacctcagaatgtgaccttatttgaaaatagggtatttgcagatgtaattagttaaggaccttcagatgaaatcatcctgaatttagggtgagccctaaacccaataattagtgtcttcgtaagaagaggagaggccacacagagacatagagaagaaccccctgcgaagatgaaggcacagattcaagtgatacggccacaagccaaggaatgctgaagaatgcctggggccaccagaaactggaagaggcaaaaataatcctcctctagagctttcagaaagagctcgaccctgctgacaccttgattttgaacttcccacctctggaactgtgagaataatttttttaagccacacagtttatgttaatgtgttatgacaaccctaggaaatgtactttagccatttttattgttgttatatatttatcaattgaacctttccaaatgaaaattatctttcaatttgcatttgatagtcaaattgaacttgcgtcacttttttccaaataagaaaactgggtcatgtattcacttttatttaattaaaagtttccaaaaaaaaaaaaaggtagaataggcgccagaattcaaaatttaggaacctattgtttatgtttctccaaaattcatttgtcgaaattataaaccccagtaggtgagggtattaggaggtaggacttttgagaggtgattaggtcatgaggatgaagccctcaagaatgagattagtgcccttatgaaaagacatgagagcttgtgttctgtccttctgctctgtgccatgtagggatacaaggacacagtaagaaggccaccatctgaaagccacatggacatcagcagacacagcatctactggtgctttgattgtggatgtccagcccctaaaattgagaaatcaatgtctgttgtttaagccacccagacgatggtattctgtgacagcagcctgagttgaccaaggacctacaaaatatttattaatcttcacaaatcagggaaatcatttctgcccagacaacctccactggggataggcagccctgtaatatccgaaattttacatatattcactcttccagcacgttaaacagcctcacctgcaaagtcccactttttctttcagtctgtgctttaatagtttataaaagccagaaatgtcatgggaaaccagacagaccacagagaagtcacacaaagaggcatgacctttgcacctgccactgactttctgggaacctcagtttcctcatctctaaaacaggtgtcctgggacacttggcaggggtaagaattgtgtgagatgatgtgtgaaatatgcacaccatcccagcacactgcaggcattgagctggcaccagcaatggtctggctatggctccgagcaccagcctccaacacttactgaatgaggggagaacaaagagtcacctcaaaaagtggcttcagcccctagcccccttgtgtgtagcccagccagtctgtcactgagaaaaccagtgactggagtggccacgtgtcaagggctttgggaacagaaagtcaggtccagtctgggctttctctaccagtgggaaaccttggtgggtttccagccttggcgagcctttgttccctcctccacaaaagaagatccaaataatccctagtaacctggtcgtaatacttaaatgatgtgatctggtaccaggacctggcagtgcataggcactcattctgtcttccctgacaagacccctgcatgaaactcagcgggtacattctcccctcctaggacacaagcatttttaaagagggttaaggtgtagagaagtccttttcttgggaaaatgattcacaaggcatctatggggagatattttcagtaggaagctgtgcaggagagctgggggtccacacactcagggtagctgtgagcagcatttccttgggtcatggggatatgtatctggaaaagggccaccgcccagtcagtgacatctctgccagggcctcaggcagactctggcccaaagcaaacggcaaagtggccaacagatcatgggctttgggtctgacagatctggattcaaataacagccacttccctgccttttgaccttaggcaaatcatgtagacttttctgagccacctcagtttccatgtgaggagtagggggtgacaatacctatgccaccagctatggcttcgcccaagcacagctcctggcatggatctggcagtaaatacatggggttttcctccctagtccatgcatggacctcagtggcctttggtttgtcagtttttttatattccttcgagatgaagttcatccatttaaaaaaataaaatacaaataagtttgatttagcaaaaatctgtgggtgacatttgctaaagttggatttatgtctcatttaatatttattgggattaagtcactgctggcctcaccccaaaacccatagaaaaagagaagctcaggtctttctaagggaagtcacgtcttacacttccccttttcaggagaggcctagtgagaatgtggttttgctccaggggctggggctggggtgggagcctggaggatcctttctaaaggctgataccccccagttattgggggcaagggggctgagaagcatttcttcttgaggcccatgtcaaccccatccaaatcccctcataacatcaagcagagcaactaagacagagccaagagcagcccaaccttggtcatggggaatcctcaccgtcctctctgtccccaaccctgtctatcctggggaagacagcccagaggcagacatgaccccactgtcccccggtgtagacacaatagcagcaaggaagacagcctgctaacctttctagaatccatttttctccacactcccacaccacggccttcctttcttgcttcttacacgcctgctgttagaaagatcttaattctggtgactgagggaaacacaaaatggtggcttataatcaaatcagcccagaagccactctgcacccaaacctatcacccggagggacgtgaaagctaattcttcaaaagccaaacacagtcgtctccttttccaagtcctgggattcagctgtcaggcctcatgaaaaccattctcctcaaggttaaaaccttaatgcactgtttgcacattgaatcaaaagaggtttgcataattaatggagcacagaaaaatcgggagacagaacgcaaagtaggttttaggagaaataaaaggcttgcaggaggaaggcatgccctcctgagtttcctgcacaagtacaaagacaccggtggaatcaaaaggcaggtcatgagaaccagccacaggggacctcttccagccttcagcacagggaggagaggaaacaagatgtctggacactgggtttctggagcaatgcttccactgtccttcaaatgtgcctcaaattgttcaagcaaactcagaacgtctctgccacgttccctggaacaatggaatgtccttgctgagaaaggcagggagcaagacgaaggcaggcaggcagcatttcctctacagacagacactgcgcagtgtcccgcagccccccaaattggggagggattcctcgcgtggcatcagtaaggggcgctcagcagaggcagcctggcatatggtgtctccaattttttagtgacaagtggcatgttagcagagctgcggaggagcggggagagagccggttggttaatcactccccattgcctgcaccctcaggcaaaatcatattgctttatgcagatgagttcataacagtttcttcaatttggcttttatagaaaaaagcgccagctcctcgcactgtgtcaacagccacccgagggcctagcactttacaaggcgagtgtattactatttaaagaccagcttttagctgaacatcagggctgccttcagagtttaattaccgccctccccatggggccaaatgagccatcgactcctcccaagggggttcggcttggtactgatctttaagtaagtgaacgctaaaccagctcatcttaaagcgcccacatctgatttcctgctctgctgcaagacagtaggtgactggtaatgacccgtgagcaatttacaatcctggatgtaattaatcttcaactgaaaataaaccagtaaaaaaaaaaatatatatatgtacaatataaaatatataatagaatttgtatttccttttctaaattatcagagaaagatctcaatagcacgtgcaatttcctgaaacaatttccaattttattacagcagtttttttctttctcctcttactttccttctcaatttgcaaaattgaatagaatgtgtttgaaaggccagggtcacagcctttctacatcctcaacagtgatcatcaaattagtccttttaaagtaccattaggtaggcatgactttgggatatataattgtccgttagaagacaaattaacatgtcaatagtagtacacagcgatattttatctgagagtggcccaaagaattaaaaatctagtgcattttccaaaagccatggaagaatcaaaatagggtaaaacaaggccgggcacggtggctcatgcctgtaatcccagcctttgggagaccaagatgggcaaaccacttaagctcaggagttcgagaccagcctgagcaacatggtgaaaccccatctctaccaaaaatacaaaaaattaactgggtgtggtggtgtgcgcccgaggtcccagctactctggaggctgaggcgtgaggatcacctgagcctgggagccgagattgcaccatggcacttcagcttgggcaacacagtgtgaccctgtctcaaaaaaaacattaaaaatgtcatttatcttcttgttttgagagaataccaacaacaaaaatattaaagatacatacatttaatttgtaacataaacaagcttggcagaacattcctaaggtgttgactgagttccaaacagaccaaggtattacattttcattctggaaaactcctgctgattcttcagtcatttacttcgagataaaaaaaaacaacaatgcatccagggctgtgagggtcccactacttgcgcttaggaagagaacagctgagaacggtaagcagtggtccttacactaccttctctcagcatccatatgaccaaacgaaataaaacaaagttccctgatatgtacatttgtgaccctgagttgaatcagttatgtctgtgttttaataggctgccaaccacactgagatactcaggcagcatgaaagggtatggaagacctaggttctaggcctgtctcataaggtgttacattttgggacaagtcatacttcagctcactcaccttcatatttaacaaagaaatttaatctgttatattgacgtttggaaaccccagctaagctaacagggagaagggctgtggtgaaatggtggtgatgaacaaacctcttagaggtacatcatgcaagacgagataaataatactgttaactaccagtatctaagctgagaaaatgtgctggctaagtcaacaggttgctgtatcctttacacactgacataaatgctgaaatgaatgaaataatgaaaagctaagcaaagagtcttgctttatggaggatccatggagcatcaagccctacgcttggtattttgagttcttgacgttatttacaaatgaaaagaaccctaccaaaatactagtcctacctataggaaatgtccgatatcacccagctagtcattggtatctggatcccagatccacaccaacaccgagccccaggcctgacactcagctcaaccaatatcctttctctgggccgtcctgcctcccagggctttctgctgtttagccatctactcaaaaatattttactagtcgggcgcagtggctcatgcctgtaatcctagcactttgggaggcggaggtgggcggatcacctgaggtcagaagtttgagaccatcctggccaacatggcaaaatcccgtctctactaaaaatacaaaaattactcaggcatggtggcacgcgcctgtaatcccagctacccaggaggctgaggcaggagaatcactggaacctgggaggcaggggctgcagtgagccgagatcacgccattgcactccagaatgagtgacagagcaagaatccatctcaaaaaaaaattgctttttcctcaaaattgccaccaagtgtctcaatccttgcaattgtcccttaggacagacccttctttccattcaacaaggtattccgaacaaacacattacgtctttgtggatatttctctagagtagtagtagctattaaaagaaaaactttagacaaatttaacagagtttaattgagcaaagaatgatttgagaattgggcagcctccagaaccataatatgttcagagtaactgagggactgtcacatggttgggataacatttatggacagaaaaaggaaagtgaggtagacaaaagggacgagaggcacagaaacagcagggctgcttacaggcttatttgagctcagtttgaatagttggatgcaagtgattggctgaaactgggatgctgtgattggctgagactcagctacttgttacagtgtagattacagtccctttacacgtccagttagatgacagttcactatgtacagagaaacctttaggtcaaacttaaaaagtgtagtgttaatgaaaaaagccaaactgaaatatttaaagaggtttattctgagccaaataccaatgaccatggcctgaggcatagcctcaagaagtcctgagtacatgagctgcaggtggttgggttacagcttggttttacacgtcttagggaaacataagacatcaatcaatacatgcgaggtatacattggttcagtccagaaaggcaggacatcttgaagtggttgggggtgttgctcacaggttataggtggattcaaagagtttctgattgacaattggttggaattgtcaattattccaaccaattattatctaaagacctggaatcagtagaaagaaactgtctggattaagataaggggttgtggagactgaggttcttattatgtagatgaagtctcataggtggctgcccttagagacaatagatagcaaatgtttcccattcagacttttaaaaggtgctagactctctgttaatctcttcaggattgggagggcctggaagatgaaagatctagttatgttaatagggattccttacaggtgcaaaatttcccccacaaaagacagctttgcagaaccatttccaaaatatggcaaggaaagatattttggggtaaaatattttgatttccttctttatctgttatgtgatattatactaaagttaggttggaatttggtatcttattgctatgaagaatctttctgtccatcttaggatctctattttaatgttaatgctgctcagtcgtgtctaaactccaaaaggcagagtgtataatgagacatgtctgatggcctctgttcctgtcatggcctgaactaccttttcaggtttccttgggtccctttggccaagagggtgtgtccattcagtcagctggggggcttagacttgtattttttggtttacagtaaggaggcagctgatgtaaagagataaactcagaaaaattgtaagagttctatttccagctgggcatggtggctcacacctgtaatcccagcactttgggaggccgaggtgggcggatcatgaggtcaggggttcaagaccagcctggccaacatagtgaaaccccgtctctactaaaaatacaaaaattagccaggcatggtggcgtgtgcctgtagtcccagctactcaggaggctgaggcagaagaattgcttgaacctgggcattggaggttgcagtgagccaagatcacaccactatactccagcttgggcaacagagtgacacttcgtctcaaaaaaaaaaagagttctcttcccttcctagacccttccaatgaatgagacagattccttgggttcacagagggagttaagaagagctgcctttagcacactgcatttctcaaatctgattcaactggaaactcacgtagtctagaaataggggtttactgaggaagatctgtatatctcccattgctgcagtgtgggaaacatctagaatgtgccacactcactgtcctgaaatcttctatgtgttagaaatgtttctatcttcttcaccaatcacctattctatctcagctattccacctgtgtgctgctgccaaaggttggcagcttcatctactttccatctgaaccagatctgaaactacatttaaatctaacacagctgaccaaatctacatgaaaattcttatctagatgaattagcatatacacaatgtttatgtattttcacctaccttcatgaactaatttcaccataattgatgccacataaatagttttgagactacaattacatgttttacacttaaaaagctttcatttcacccaatataataatgggcattattttctatgcttaaggactgaagtattacagcaattgtagtaaaaaagtaaaacattatacagctcatgtggaaacagctttctaatttttttaagactaagattaggatgcaaatccaacccggaaattgaaccatcactaagcatctttgttcatctgatcactgctcaaaaccatctgcactgaattgtaagatattaataacaaaccgtttaacaatcagctaggattaaaggacaaagcctcttagggacagtttctattggtggattttaaaaataaaagaagaaacagcacaagtcacatttctttctagattgtagaactccacaaaatgtttttgtttatatatttaagcagtgcttttatgaaagtaccactggacttaccttttatgccttggaaagggcatatgtagtatctgaggatcaagttcttctgaaaatttccagcaacttttagagatcaactcaatgacagtatgtcattcaaatcagcattttatattgaaaggcctgtggtgataatgtggaaatccaccaggattcccctgatgcaaggtttcaggaggtatcagttatttgtgtacaggacacatcccaaggccctgcaagaaggcccctgcattacaatgtataatgtaagaaaattcagatgtgtctaactctttgcaaacaaataagatttttacatatatatcattaaccaaatatacctttaattttttaaccaatccttcctcttctagccaacaactgtgatatctaaatgcttctcactcttcattcccaagataacacatccgtttgcacccaaaagtatattgcaaacacctgccagcaattcatgcttcaattctcaaatccatttcaacctgtaaatttttcttctgaattattttttttaacattctgtgacagagtcataggatcactaaaacaagactgttaaaaataaaaggttcatgaaagatcacctagttccattttctcatttatcatatgacaaaactgaggcccaacaggttacgtgacttatcctcctcagagcaaagccaagcggaggaggaaacaaaaaatcccagatcttgaatcagggtgcttgtcattgttgtcatttgtagaggtattgtttaagacagggtcatgctagatgtccaggctggaatgcagtggctatttacagatgtcataacgcttactacaacctcaaactcctgggcttaaacaatcctcctgcctcagtgtccttagtagccagtagctgggactacaggcatgcatcaccatgcctggctgtttgttttgattgttagtttttttttttttttttaatgcgacaaattgttggattaaacgaattaaaaacattttagaacataactgcaaacaataaaattagactgcttctgctaagtcttacttaggtgcaagatccaggggaaagggcagctatcattcttacaaaaatggaaagatagtttaaatcctggaaatacttgtctctgactaggaatgttttcccctggccagtaccatggggaaagttcttctgtggacctagcctttcagggacccctcaagtccttcaccttgtggacaattttggggaaatgagccaatttcgacagtcatctagtcaacagtaacaggaattccattgtgtactgaatatagtactgagtaaagaatatgagtaacaaatctcagaaaagtatatattacagagacggttatccactcacatagagggagacatactctcctcctatgctgtattgcactaaattattttttaaaattatagaggtaattcctatttttaggtattcttagaagatgacagaacaaactatatgtaaaatataaaatggattttggtaaccttctggaggatactaagtgtaatctctgctcccataatatttcatttttgtttttacgtttttgtaaccaccaacatgttgtactggaatttaacacttgacacatggtattgaaattgtttattttcttggtgatttcccccattacattgtgagccccttaaagacaatgttttattaattttccagtaggtagcaccaagcccagtacctagtgcacagaaggcattcagtaaatggtggatgaattaacaaataaaagaatgagtgagtgagtgaatgaaatgatgcatattttatatttcaaaaatctttatagtttatacatgattaacttgaatattttaaattcaatattcaggcattcctatcctcactttccagaaagcctgatgatgttaagtaactagctcagggtctcacatccattacatgagaaagccaaatctagaatccagatggcattccatttgcttggggaacacagggaagaaaaaagcacacgtgatcttgagcatttaaaacacagctctttaatcaggcagatattttccagatgcctataaaaatgttttgatagtaacatccaaagaaaaatagtcattcctcattaccagaacccaatgatatgtcatttccacagtactgagtttttgaggcactagtaattggcttctgaaaccttctaaatatcaagatcgagtaatgatatttaatgatgccaaaataagaatcagaatgaaattttaaacccacattatattgtatttaattatagaaaatgacatattaacttcctcatataaaacgtttattctaaatgtgaatgcagaacattttgtcaaatttcaaaccaacgttttttgttgttgtttgttttttaagacacagcatctgattctgtcacccaggctggagttcattagtgcaatcatagctcactataacctcaaatttctgctcccaagtgatcaacttgccttagccttctgagtagctggcactacaggtgtccaccaccatgcttggctaatattttttttaattttttgcagcgatggggtcttgctatgttgtcctgactggtcttgaagtcttatccttaagtaatcccccttcctcggcctcccaaagtgctgggattacaggtgtgtgagccaccatatacagctcaactgaggtagggggattacttgaggacaagttgggtgagagaggtacctgttagaagatactgttaaatgttccagaaaaattctgtcagtaagaaaaatagagtgtatagaagaaaaagtgatgtttaatatttgcttaaattttctctgcactttttctacctccaaaccaaatcactatatagaataatcacctttgaggaaagacacgtctaataatgtttataatattcagaagatgagattctatgtatttagtttactcttgaacaaagccacagtgtccagtccccacacagttaaaaatatatgtataaattttgactccctcaaaacttaactactaatagtttgctattgactggaagccttactgataacaaaaacaggcaattaacacatattttgtatgttatctgtattaaatacagtgttcttacaataaagcaagctagagaaaaaaacgttattaagaaaattgtaaggaagagaaaatatactactatatgtcttagtctattttgtattgctatgacagtatacagaggtctgggtaataattcataaagaaaaaaggtttatttggctcacaattctgatagctggaaggttcaagattaggcatctggtgaaaaccccagacagcttccactcatggtggaaggcaaaggggaaccaactgtgtgaagatcacatggagacagaggaagtcagagagagagaggggaggtaccagaatctttttaaatatcagctctggagggagctcacagagtgagaactcactcacccctgagggatggcattaacctatttatgatggatccacccccatgacgcaatacctcctactaggccccacctccaacatcaggggtcaaatctcaacatgaggtttgaagggaataaatatccatatcatagcactattcattaaatggaggtggatcatcacaaagttctccatcctcatcatcttctcattgagtaggctgaggaagaggaggggttggtcttgctgtctctggggtggcagaggtgggagaggtggagaaggtggaaggggaggcaggagaggcaggcacacccagtgtaagttttactgaaaaatatccacatgtaagtggacctgcacggttcaaacccatgttgttgaagggtcaactgtatatcaatatttactgctatggtgtggatgtggtttgtccctgccaaaacccatactaaaattttatccccagtgtggcagtgttgggaggtggggccaagtggaagtttttctggttacggggtaaaatacttcatgaatagattaatgccctccctcaggtgtgcattccccttctctcgggaattaattcctgagagagtatgttgttaaaaagagtctggcttatttggcttttgtctcttgcttctttttttcttttttagacggagtctcactctgtcccccaggctggagtgcagtggtgcgatctcagctcactgcaagctctgcctcccgggttcatgccattctcctgcctcagcctcccaagtagctgggactacaggcgcccaacaccgggcccggctaattttttgtatttttagtagagaccaagatggtctcgatctcctgacctcgtgatctgcccacctcgtcttcccaaagtgttgagatgacaggcgtgagccaccatgcccagctgcttccttttttcaccatgtaatctccctgtacatgcgcacttctcttctgctttttgtcatgagtggaagcaacctgaggccctcactggatgcagatgctcaatcttaaactttccagccatcagaattgtgagccaagcaaacacctcttcttaatttgtcagcctccagtattatgttatagcaacacaaaatgaactaaaatgcactgatacatatatacacacgcactgatatctcactagaccataccaagaaagacccaacaatgtggatcaacaggattttgctacaaacgttagcaatacctgtttactgatcctacagtatcttattgtgtagcttcacttaatatatttggcgttgggcatgtaaaaggttttcaaaagaccttgtatatttgcatagataatataagtatacttccataactagtatccaaggatcatcggtaaattagtttccatgtctttcattagtctcagatactttccatcacatatttctatcactgagaaaaacaggttatcatttgattatctctttatcagttgtcattaaaatgatctagaggccgagatgggcagattacgaggtcaggagatcgagaccatcctggttaacacggtgaaaccccgtctctactaaaaaatacaaaaaaattagctgggcatggcggcgggcacctgtagtcccagctactcagcaggctgaggcaggagaatggcatgaacctgggaggcggagcttgcagtgagccaagatcgcaccactgcactccagcctgggcgacagagcaagactccatctcaaaaagaaaaaaaaaaaaattatctaagttaatttcacttataaagcacagactcctatctagtaagtccatctatagaatgagagagtgaattatgttttaaataaacagagcagtctgcaaacggataatcaaatgatctgggatcccaccagtcatatctcatttagagcaagacagaaacattgatagttctcttcatagcttatgcatcaataaaaatattagatacacttttcttttttacacttattttcaaagagatggttcactttctctctgtatattgtaaatccttcaatgttatttttaccaagtttttgtcccttttcacaaaccatcctcgttatttttatcaccactggaattgattttaaaagcttgattattcttgacagggcacagaggaatgtccttcactacgtatgccaggatgaagtgaatttataagcccacaagtagatctgataagcatgcagaaatcatttgtattatgtgcataaaacagtgcccgattaaaggacagtcacattttcttctgacaaaatgtctgtggcactccagaaaacaggctttattttttaaggtttacctcataatgaaacaaagtttgaagtggaaactcttaaaatgcacaggtaggagatgcaatgatacaatccaatgcaataaaataaaataaaaccatgaatgagcacatttggaagaatgaattctccagttaaagtaggccgggcacggtggctcaagcctgtaatcccagacctttgggaggctgaggcgggaggatcacgagggcaggagattgagaccatcctggtcaacacggtgaaaccccgtctctactaaaaatacaaaaaattagccgggcgcggtggcgggcgcctgtagtcccagctactggggaggctgaggcagaagaatagcgtaaacccggggggtggagcttgcagtgcgctgagatcgcaccactgcactctggcccgggcgaaaagagcgagaccccgtctcaaaaaaaaaaaaaaaaaagtacaagtaaagacaaatgattttaagcagaataggaggttaagagaaacagcctctcatatttgagcacctctcaggatccacataggtatagaaacagagttcattagaagtttatgttgtagttctgggatctcatttacacaaaacacacaaatttgcaaacataaatatcaatgattcgggacctataagtcatatagaagtcagcttattgcaacatctattgaaatgaagcagttctaagatacttaagaactttttttccctctctgtaacggctgttttgatgcttttaaaattttctgtcttttttttttttttttttttctttgagatggagtctcgctctgtctcccaggctggagtgcagtggcgcgatctcggctcactgcaagctccgcctcccgagttcacgccattctcctgcctcagcctcccgagtagctggggctacaggcgcccaactaccatgcccggctaattttttgtatttttagtagagacggggtttcaccgtgttagccaggatggtctcgatctcctgacctcgtgatccgcccgccttggcctcccaaagtgctgggattataggcttgagccaccatgcgtggccaattttctgtcttttgaactaaacacttgtgcttaaattctcacccacgattgctctttctacactaaaatgtgaagatgtaggagcagagaggcagcatttgcagggagaccatgcatgttgtctcaatacaaggaaggctcttctgttgctccaggaaattagttgccctggatgtaggagttacctagagaagctcagacagaggctggaagataagcagtcaggtaggcaggtggctccagggggaccccctgtgtggggtggaaagctggaggtaaggatccggaaattcctggccagctctagatttcacaacaccacgttccccatgttcccggggaatattcacaagaaccctgatgccgatgtccaccccatccgtactgaaccaggtttgcacatcggtgttttcagtctacccgttgttaatacagcgactcctcgacttacagtgggattatgtctggagaaactcattgtaagttgaaaatatcacaagtcaaaaggcatttaatacctctaacatactgaacatcatagcttagcctagcctacttgaaatgtgctcagaacactcacattagcctacagttgggcaaaatcacatccaaaaaaagctggcaacacaatgcattgtagagtaccggttgtttgcccccgtgacagtgtagctgactggggattgcagcttgctgcctctgcccagcatcaaaagagagtatggaaccacatattgctagcccgggtaaagatctagtttgaaatctgaagtatggtttctactgaatgcatatcactttcacaccacggtaaagccaaatattgtcatagtaaagtcaaaccatcattgctcaaggaccatatgcttatgtaaaaatcccagaaaacaacttgagggtgtccactttgtttatgaggattacattaagtgtcgtatgttaacaaacattgacaaatgatgctttggggaaagaaggaaaactctgaaacggctaaatttcactaatattaccaatattaaatagcatagtgtatttggtaagagcataggctttcgattgataaggagccaggcttcatttccacacctatctaatgacctaaactacaggtgtggtaacagtgatgatggtaacagtctaaaatggcaacccagtagttcagattcaatgtgcctgcacccagcaccccctggtgttaacttaccctacagtcaacagttcttttcagggtacatgaatcctttgaaatataacctacaaaatatagattcctgtgtgtatgctgactacacgtcgttccattattttctcaccggcagaaagttcttaggaataatgtaaactcacttgttttcatttgtctatttcccctaactttgttttcatggtgacaggccactggttcctgacctgctatttgagacaatttatatgatcatcctttagcttctgcttcattcagtgataccccatttcctctattttcctctggcttttcttcaaatggtttatattttaataaaacgtggggtttgtgaaggtttttgaaaatgagacggttttcttatctttctctttccttttttgtttcaatcttaggtctgagcccagatctcccaacgacatgctttcatgaaacaataatgacgagaccgagtgaactaagctgtcttcagttttggagatgcagaggccaacactggcagttcctgacatcacttaagggaaaacaaagctaggggcaaaaatactaaggcagcctagatttgggggccctttgtatacactccaatttttaaaataacatctgggcatacttctcttttaaactcttcaatccacatatttttcattattaaaaagtgacttcggtgacattttcaaacactaaacaaacttagccatatgtccatttcactgactttccccacatcgtggtctctccttataagggatgggttccactcttgggctcaaatgttttgcttttctgtgtctgctcaactaacacacccctcctgatatggttaggctttgtgtccccacctaaatctcatcttgactgtaatccccaggtgttgagggatagagctggtgggaggtgactggatcaatgcagtagtttcccccatgcggttctcatgatagtgagtgaattctcacgagatctgatggttttataaatgttagtttttcccagactctcacatgctctctcaccttctctctcaggccatgtaagatgtgcctgcctccccttccgccatgattgttaagtttcctggggcctccctagccatgtggaactgtgagctaattaacctcttttctttataaattacccagtctcaggccgttcttcatagcaatgtacttcataatacacctccctagacacaccactcactcagagaaagctcagcatcatgtttactgtgtaatttctcctcactagtcatttgctatttatttctctcacatcatcatctcttcctgaactgatttttctactacctctgaaaataacagctcattagaaagtgatcagagattgagtgagcaattgaatataattacacaaaattatacagaccttaaaccagacgctctgctatgtgtatgagcctgggaaagccaaagccctgtatttcagtacccagtgctgctggaggtcactattgtggccctaaaagggaaagaggaaatgatccctggctgcaatgctcacaaaaactacttggatcctgccctagaaaaaggaccagagacagaaagggcagcaatacgtctgtcgcctgcacgacatgcactaaaagtcaacggctaggagagagagacgcaaaaacaaagcatcttatatttttctttttatttcaatttttattttagattcagaggctacatgtgcagaatttggctgatagagacaatcgcccggatttgctgaagcagggtgagttatccctaagaaaagcttacacagaagtggaagacagtttattatctaggagagccaccacatctcaaaatgtcaaaactgccagtgtgttcttgcacactgaaaccactcacaggtcaaccaactgtcttggtttgtccaggactctctcattttttttactgaaagtcatgcaactggttaacttctctgtccttgctaaacaaagatagtttgtctcccagcttgaagtcacctgagatcaagagatctactactaacacatcatagagaagcagcagaaatactacctatattttgaaatacaggtagtattatcattgatctggtggaactctgagaacttcaatccagaaattctcagagttccaccagatcaatgataatactatctatattttgaaatatatatatatatttgtttatatatgtataaaacaaaataaaaatttgtaaaacaaaatatatctatttgtttatagttatatgtttatatatgtttatatgtttatatatagttatatgtttatatgtttatatgttatatatatgtttacatgtttatatatagttatatgtgtatatatagttatatgtttatgtttgtttatatatatgtttatatgtttatatatagttatatgtgtgtatatagttatgtttatatatgtttatatgtttatatatagttatatgtttatatatgtttgtatgtttatatatatgtttatatgtttatatatagttatatgtgtatatatagttatatgtttatatatgtttatatgtttatatatgtttatatgtttatatatagttatatgtttagaagcagagccataaaaacaggaaaaccaaaacagaaagagcctcctatgaaaaagcacatttcaggggagaagggaggcagagtgagagcagagctgtgagcaaggccagccatgcaaaaggcacgcggctgaaagcccttggttctcaggcttcccgcccatctgagagatgcgtactctgtgccctgctgtttgtaaatgtcaaacatttaatgataaccacaataaatgtgcttggtcagcagtcctaaatatggaaaaagaaatcaacataaaacatctttggtagtttcttttccttaaaatcttgtgtcagaggaaagtacacagttaccactggaaacaaagtggttagggaactctacaaaacagaccactgcaggggaaaaaacaatgattttgagagtatgaattttcctgtgaggaacaaaaatgaaaacaatggtacgtttgtcccttccaagttcttcacggatgccagtaactaatcttcagagtaaatttggagaaattgttctgactatgcacacaaagaagctagagggaagaggcagtgttgctttatttactcagcgttgacctcccaccaccctcctccttcctctacttctctatcaatacttctggccttcctttgacctgttttggggcatggacttagggctgaggacagcaccaagtatctcgcctggatcctgccaaccctgcctcctacaaaaaggtcactttgagccactttgttcctttctctaggtctgtctctactcatgggattgttttcaagactaaatggaatgagcacgtgaaacgggaacctgccaaggctagacccttctgtgtcctattctgccagtcaagaaataaaatttcctaaaattttgtgtcttgccttaaaaacacacaaagccacattctttccataacaaatgcaagtttattttaatacctaattagggtgagaagctgcttggcaataaggagaactggtgtgccagcaaggtgtgctgtacagacctagttgctccctgtgcctccaaggtgagcacctggagattggaagggaagaggcccaggtgggatgggcagaggtggaggggaggatactgctcccctgacacacatgacccaacacggtgccatttccaaaatactttaaggccatgttgtgaagacaacaaagtaaagacataagacaggagccaagaagtgcagcctttgtatgcctgctgccttccagtagccgaggtactggcttctcctctccagccagacctgctctgctacccaccatggctactgggtgtctatagctgaatggccaatgcggctaatagggcttacatctcttgacagttgagcagccatttagggaaattagagacactgtagctcgaagaagaccatgaagaggaagttctactcttatagaacagagaagccatctgtgactacgtaataaactctcaggggtcagggtaggtgatcaggggtttttgagctgactctagcctatccacagcttctgactgatgctaatctcaaccaaagaatgccaagatattaatatgttcacagagaagcctcatgccactgatgtcatagaaataggtcacacataaggaacacccttggataagtgacatatcacacttacattggaattaatttccacaaaattccattgctgtccctaccttctaaatagcttctgaattatcatcagcacccacatgttcacactcagtgcctcgggggcttcaagatgtcccagaaccgcagccagcagcccagagtgtcttatctgaagaagggccatattgcctgtccacatgcatccttaacatcacatggaaagggggattcaacttcaacagagggaaaataccgccaggtgaatcactttcaactacacagaaggaatcacaaatgtctgcctccaaaacttcagagtcccagtttattttgtaaaattggactcttgtcactcctgtcatttccacacatgcaggtcccccagcatgaacgcatgaaccaacaacatgtacccttttatatcaactttacaccccagccaagagaagcttcatgaaaaacggcacataaagataactaaaacatgacttctcaaaccaaaagggtttaagtctagacgtaagccaaactctgtaaaccctctctgctaaatcagtcattaagatgtcatcctttttcctctttcacatatattattattgtcctacatttcatgtttcagggttttctccttagcctgctgtaagcatgtgctttgggagacagggcagaagctttggcactgttgacgctcagaaacggccaccctagatggctagtgatgctggggagtctctctggagacatcataacaagaatgccatggcctgaaacatgcttaccagccatcatccagagaagacaagacactgaaagtaatatcataaaatcttactaacataatcaagagaatcccatgtgatctactctgccagacattgctgaacttttgaccttcaactgcacctaagtagtttaagactctccagacattcattgactcttgcaagcttgcgtttatcacaatttagcttttcacaccgctactcaccacccaacacattattcattatgcaaaagtaatttgaattcatcatgcactggatttagcaaacttatctttaactgagtttcagattatttctaattctccctttagttcagagccatatgggctttgtgacacagaatgctttgaaaataatttcattggctggaacattcagtgggctgatgccacatttctttgaaaaaaagtctgctaggaagagaagtaaatatccccccacccaccactactgctattgccaggttcctccactcatgtattcatgtatttgctcattcattcactcattgaacaaatatgtgttgcaccctaccaaatgctgagcatcatacttgctgacaacagccttggcttcattggccctctgtgagacacaggaaagtggggatggacacaggttgaagatgacccaagtccgtaagcacaagcatcctttcagtgcgaaggagaaatgccaagaaacaacaagcagaaggggtgtaggcaacagaattattaaagacacataagcagggccatgttaagatgctcatgggtcctccctccccaaaaatcagtgttacattttatgactctgtaagtataaagacaaatacaatcaggctggattacatatgtttttccttctgattttaaaagaaattaaaacaattgtcatgggctccaaaacgtatcctggtttcagacactgaacttactgtgcctagcaaatagttggccccggctttggggcctcccggtcttccaccacccattaattgaacggcctttgtgcaaggtagctagctgcttaatgcctccttgtcttccttgctaagacgaaggaaatggaaatgaaagtgcctggtttagtgctcaggacacagccagagctctgcgtttccgcatctcctctccacaccaaataataacaatttgctctagaagacaatggacatccaagtgaaataaggctcaagggactgcagccgttttttattagttatccactagtaaatgcactaaaccaaagaagccccacttcaaggaacacagacaaacatctgtctctataattatccatacgccccaaatgcccctcctcatctcattccccctacttatcactctgaacatattctacaatggacttactcatcaggcccaacatctgtctcccctcacgggaatgccagctccacaaggtcaagggctgggatgttttgtttgctaatgtgttagcattcccaaacttagattagcatcaggcataacataagcactctgcctattcctcgttaaatggcatggatttgaaaattatcagaaacactagtttcaaaaacattaaaattcagtctttaggatattttgttcctttctataagaatttattctctacaaaactaccactcttgatctagtgtttttttgtttggttttttttttgagactgactctcattctattgcccaggcaggagtgcagtggcgcgatctccgctcactgcaacctccgcctctagtgttcttgatagtgtagataatcagtatgttttcctgtctcttcttctttccatttctgatacgtaaactatgtttgattgaagcatttagcaatgaatggggaatgcatgtgtaccacccccttcttcctgtatcaaattcttttctaagtcacaacatcttatctaaattttataccattctgacagtttcccaagaagcaaggagaaagagagcatattagcaaagttacttgtctatccttattaaagcacagtgtgttagtatggttcaaatatatatattttttttctttaagattgctggtctagttgaaaaaagacaatgaatttggattaatcatttccaatattctgattatacaagctaccccattgcctccaaaaaggagttctcccaggtcttagggtgttttttgtccttcccacagaccactgcaggcacagaaacactccaggctgtacattcaaggagatgcttaaggtatttatatgtggagacttatggaaaatacaaaatattaaaatgatattttcttcctcggggaatataaacttgtctccatttttatttaaaatgctggaagttatattgatttttattatagaattaatatagtcacatagtaaaagttttagtaaatacagatgggtagaaaggcaaaataaaaataaataataatcttacactttgagaataaaataccagcattttaatgtctgccctataagcagacaattttgtgcagtgggcagaatgatgtgagagaggccccaggagctcactcagggcaggctagacaatgagccaactggaagaagggggtcctcctttctgttaccacgagggctgtagcaggaggcctcttcccttggcagcagggcccacatattcccatgggcctcagcatctccaggtgctgggcagctggctgtcccagacaactccagtaacagctgatgcctaatcccagataggctgtttatccccctgcctagtagcatttctttggggcttacaagaagggagagtcactgggtgcaggagggtccctcaactggacacagacctacccactgtgcaggagagctggccccagggtgccttgctgttggatgatgtcaggattcacagccctttcattttcttgcttccatttattttcttccttacagtttattctttaacacatactgtgccacactgtggaatagacccttactcttgtgataaacagttttatgtatcaactgggtcaggctatagtttccagttatttgatgaaacccttatctaggtgttgctatgaaggttattgtgtaggtgtggttaacagctgtaatcaatttactttaagtaaaggagattgtctttgatcgtttacgtggccctcattcaatcagtcgaaaagatttaagaggaaaactgaagcttccctgagaaagaagaaaattgctcctgtgaactgcggcatcagctcctgcctgggagttctagccagccctttctgacagcctgccctacggatttcagacactctcagccccgccccatagttgctacagcaattgccaattcctaaaaacacttcaagcgcttcctcttcagatttctatctgtcccctatataacttactggttctgtgcctgtggtggaccctgactgacatacctcccttgtaccagagctgtatcagacctttcaggagcttcaattatgaataaattagaaatgacttctttaggtaaggtttatgaaacttggagtttttcctacttattttttgtgtgttcacactggatttcagatgtcaagagagcaaaatataaatttaaaatataaaaataatatatagaacatagaattagcaaacagcagaaaaaaaaatttgtggtatgaacgtaaggaagcaaggacaaatgtagtgaacaaaatgaatgccaaaagctgggatgagtgcaggagaactgaggtggatctctgcattccccaagtaccctgcagtggccttcaaaggctgagggcagtccattgatgcaaaaagagatctccccaggtacagaaagtcaagaacaggtctagagagcaaagagaatgccccagaaactcaaagagctggcaggcaagctgtaaagcagaaagagatctcccacagtttggaaagctggttactggtcagtaaagcacaaagattcaaagagtctggctggtgctcagatcccaagcccttctgaaggcaaagtgctgaccccaccttcacaccatgtgaacccaaggtaaagagaatctagctcaggatcctaactctgcaacagagcccagcacagcccagccacatgtcagattgactcagccccacatcaccagcccgacagaaggacagaaggagcatgtccttcctgcaagggcaaggtaaacattccttacttcaatctgcacacaatgtttagcataaaacagaaagtcacaagacacacaaagaaacaacaaaacaaggcccatgtttaaaagataactcattaacagaaacaaatatggaaatggcccagatgtttgatttatcactcaggaactttgtagctgcgatgaaggctctagaggaaaatactgacacgtgtgaacaggtgaagaactacagcatgggaagcaaacggtgaaagcaaaactcagatggaactatcaggacgtaactgtatgatactaggtaggaagaattcatttgatgggcttaatagcagactggacatagaagagaaaagaatcaaaggcaggccaatagacaatatctaaaataaaacacaaagaaattaaacatgaaaaaaataaaacaaagcatccaagacctgtgtaaaaatatcaatcaatataaacaattggaatcccagaagaagaagagagatacaggagaaaaaatattttaagagacaatagccaatattttttaagttaaggaaatacagcaaggtacatacccaagaagattagcaaaccacaacataagattttaaaaagttatttcaaaatcacacctaggtacatcagaggtgaaccttaaaagaaaaaaaaattgaaaagaaatcttaaaagtagcaagaaaaaatagcccatgttatatttaggggaagtatgaaaagaatgatggatgagttcctcacaatggaaaaaaaattcaaaatgctgaaaaaaaactgtcaacatagaattctacattgaattctacatttagtcaaagtataaataaaaaaataaaagctatagaagagagcaattcaaatattcttctcataaataaaatatgaatattcaaggtgatagatatctcaattaccttgatttgatctttacacttgatatgaatgcttcaaaaaatcacatgtatcctgaagatatggacatctaatatgtatcagtttaagaaaatgaaagctaagtaaagacattttcagctagagaagaactcagagatttttttagccaaaaaacctgtgctccaagaaatgcttaaagaaatgcaggctgaaagaatatcatacatgatagaagctcaaatctgcaggaaagaatgaaaacataggtagtataacatataggtaaaaataaaggacctacttattatatttaatatacatgtgtgtttgtttgtatacagacatacatgttgcataatatattaagcacatattaaaggttgagcatccccagtccaaatatccaaaatctgaaatattcccattttagtagagatgaggttttgccatgttggccaggctggtctcaaactcctgacctcaggtgatctgcccacctcagcctcccaaagtgctgggtttacaggtgtgagccactgcacctggcccaaaatctgaagctttttgagatccaacatggcattccaaagaaatcctcattggagaattgcacatttcattagggatgttcaactactaagtatataatgcaaatgcaaattcaaatcctaaaagatctgaaatctaaaacatttctggtaccaagcacttgggataagggatactcaacatgtgtgtgtgtgggtgtgtgtgtgtgtgtgtgtgtgtgtgtgtgtttgtgtgtacatatatatgcatttcagcacaaccagtagcaatgtgttataagttttatagaatacagtgaaacaaaagaatacaaagaatgagagaatagaattatataattgtgatagtcttagatttttttaaagtttagtataattgaaaattagactatgatagttaagtatacatactgtaatttctagcaaactcctaaaaaataacacaaagtatatttaaaaagttaattgctggattatgcaaaataaggcaggaaataagaaagagaaacaaatactggtaaaatacttaaatacaattgtattgataattacattaaatataaatgaaataccacttacatactaattaaaaataagattcaaataaatgacttttacaagaaacacttagagcataaagagatagatatttgaaaataaaatgttgaaaactgacatactatccaaccactatgcatcataaatctcgacggctatgtttatatctgaccgagtacaattcaagacaaatagtaacccagagagaaaaaggagtatattctaatgctaagagtcactccatcaagaagaagtaattatcttaaatgtgtatgaacctaataaagagattcaaaatgcatgatacaaaacttgacagcactaaaggaagaatgttgcttttgaaaagctcacattcaccatggaagattttaatatgcctctcattataactgataaaacaagtagaccaaaaatcaaagaacataggagattttaatactgtcaacaaaatttacataattatctctaatagaatactccactcaacaactatacactacaatttcttgagaagatcacatgaaacacttgctaagatgaatcacattctgcaacatgaaaaattccccagcaaatcataatgataaaattcatataaagtatgatagctgaaaacaataatattaaaatcgatcccagcactttgagaggccgaggcgggcagatcatgaggtcaggagatcgagaccatcctggctaacacattgaaaccccgtctctactaaaaatacaaaaaaattagccgggcgcggtggcgggtgactgtagtcccagctactcaggaggctgaggcaggagaatggcgtgaacccgggaggtggagcttgcagtgagctgagatggcgccactgcactccagcctgggcgacagagcaagactctgtctcaaataaataaataaataaacttgaaataaatgaaaataaatagctttaaaactactcaaatatttgaaaattaaacaacatgtttctaaacagatgatgacctatagaaaaaccacagggaaaaataaaatatattttgaattgaatgaaaatgaaaacacaacatatcaaaatgtgaaaggcagtgaaggtggtgcatagagggagattcatagctttaattccctatttgaattgaaaataataagttgtaaaacaaaaagttttagcttttaataagctaagaaaaacaactaaaatataagaaaggaaataataaaaacagcagaaataaaatgaaaacacataaaagaaaattaacaatgtgagaaatttgtttaagacagtttaataaaattggtatacttctagaaaaattgtcaagaaaaaatgaaaagaatctatatcagtaataaaagtagtagcatctctccaggttctacagatattaaaaataagggaatatcataaacaactttatgccattaaagatacagccacttatataaaacagattcctttaaaaacgcatcttatcacaactgatgcaagaaaaaatagaacatctaaatagcctaatacctgttacagaaatggaatttgtaatcagaagccttcccataaaataaaacaaaaacataaaagaaaaaactcctgactagatgtcaatatctaaggaaggcgtaataccaattaccaatccttcacaattttttttttaatagaggaggagggaacacttcccaaatgactttctgagactgcacgacccagatattaaacctacaaaaaacattataagtttaagaaaaaagaaaaatatcccttatggtccaatacacaaagatctattaaaatattagcaattggatgctataaacttaaaaagaataacaggtcatgaccatgtcaagtttattttctaatacaaaattggcttaacattaaaaatcagtcaaaataattcatttcattaacagattaaagaagaaaaattatataactatctcaatacatgtagaaaaagcatttgacaacattcagcttcttttatgagaaatactcaaaaaactaagaataaaagagaactttcacaatctgataaagggcatttacagaagatatacaaataacatgatatctaacactgaattattggaaacattccccttagggttaggaacaaggcaaaggtattcactcatcacttttagtcacttctaatcaatattcaacattgttcaagaagtcttaggtagtgcagtagggcaagataatacatttcaaaagccaaacaatgtcaaaaaagagaatcacataaggtgcctgattttttttttttttttttttgagacggagacttgctctgtcgcctaggctgggtgcaatggcagggtcttggctcactgcaacctccacttcctgggttcaagggattctcctgcctcagcctcccaagtagctgggattacaggtgcccgcccctgcacctggctaaggtacctgatttttaagactgcaataaaacattagtaatcactaccatctcaaaacaattatacaatttgatttctagaacaaccatattgtcaggcctctgagcccaagctaagccatcgcatcccctgtgaccttcacatacacactcagatgtcctgaagttactgaagaatcacaaaagtgaaaatggcctgttcctgccttaactgatgacattccaccacaaaagaagtgaaaatggccagtccttgccttaactgatgacattaccttgtgaaattccttctcctggctcatcctggctcaaaaagctcccccactgagcaccctgtgacccccactccggccctccagagaacaacccccctttgactgtaattttcctttacctacccaaatcttataaaacagtcccaccccatctctgttcgctgactctttttggactcagcccacctgcacccaggtgattaaaaagctttattgctcacacaaagcctgtttggtgatctcttcacacggacgcgaatgaaacatatataattaagacagtgtagttttggcataagacagacaattagattacgggaatagaatagagatctacacatatacggctctttttaaaaatcaaggtgcaaagccaattaggtgacaggggatgaaagcctgtttcataaataatattgtaagaatcagataaatagatggagggaaataaaccttgagtccgactcaactccttatgttaaaattaactagagaaaaataaaagaattaggcttcatcaattttttaaatttgctaattgaaaggcatcactaataaataggtaggcaggctacaaattaaaaacaaaatattatacttgacaaaagattcatacccaaaatatattaaaaaaaaaaactcttgcaactcagtagtaagaaggcaacccaagaaaaattaggcaaatgacctgaattgtcacttcccagaagaagacatatcacgtccaatgagcacatgtaacagcatcattagtaattagataaagacaaatttaaacaataatacaataccatctcatacacactatattggttaaaatttaaaatactgttgggatgaaaagttggagagaatatggagcaacaagaactatcatacatttctggcaagagtttaagtggtaccttttagaagttttataaagttaaacatgccatcccacttagtatttccccaagagaaatcctaacatatgttcacaaaaaggcttctacaaaaatattcataccagcctttctcctattagtcaatccctggaaacagcccaaaagtctggcaacagaataggaaaaatgtttagaaaagaaacaaagttctgaaatcagcaacaacatgtgtgaatttcagaagtattataatttaaaagaagaaatcagatacctaagaatacataccacttgcttctatttacataacaggtaaaactaatttgtgttcaaatcagaaaggattgcatctgggttgggtgcaggctgggacactgataattatgggagcaagggaatcttctttggggacagttaactgaatgttctacatcttgttttaggtggtgtcaacttgggtgtcttccaatgacaaaacatattaagctaaaaaatgatcagtgccttttattgtatataaattataattcaaaaaatcatttaagagaaaccatgagtttctgtttaacacaggagaacagagacaagttaagatagtggcagaatgggagaagacacctgcaacatctaaaatcaacaaaatttaatacttataatatatatatagaactcctgaaaaatccaacagaagaagacaggaagccccataggagcacaatgaaaagatataaatgcgcaatttttacgtaaggttcaaataaattatttcaaaactcctagaattaactaataatcataaaaagggctaagatcacgaaatatctttttatacctttgcatctatcaacaattagcgttgcacccaggcgagttagagaaaacgccacactttgagacgagtatacatatgtaacaaacatgcacgtcatgcacatgtaccctaaaagtataataacaataaaataaaaaaaaaaataagatgcaaattggaaagggcacgagagggtatcttagtgaaaattctatgtgaatttatatatcataaatttataaattaattcatccattcattcatatattatgaacaaaatatatgtaatgatatataaatgaatattcatttatttatgtattatatattcattcaccatcccttattatggagaaatttgaaaatataaaattatttactcaaaagctttattaaaaaaaaaaaaaaaagagtcctttattagccggcgaccaggccgcttccctcttaccagaaccagaacaaagtcaaatctgacctacctgaccccggggtgagaagctgaggactcagatgttgaattttagggcactgacacggtagtcgatccgctctcctccggaagacggtcactctttggggacctgaaaattgtttcctcaggtggcgcccccctccgagccggctgtccttccgggggagcccggagcgagactggctctcgcccagtggcgttaatatcttgctggggcctccattatgttgtatccaggcaagtcagagaaaacgccacactttgggatgaattaagagtcctttattagccggcgacgagagacggctaacgctcaaaattctctcggccctgaagaagggggtagattttcttttatactttggtttagaaaggggaggggggtctagttagaacaattttacagaagttaagtaggcaaaaagttaaaaggataaatgattacaggaaagtaaacagttccaggtgcaagggctttaagactactacaaggtgatagactcggggctttgggcgttatcaatcagacgaaatcctgggaactgcggatacagctcgccacagtatcttatcagttaattgcattcttggatgtgctgggagtcagcttgcacaagttaagtccttgaggaaggggctgccagtcaaagagccaagatggagtctatctggctctcttagctaagggagaatcaattcaggtggaaacaagcctaaaaacagagttagtaaaaacaaagttgggcattacattagaaaaccaggtatttgcaaggattggtgagtatataggaacagaagaaccctcatgcactgagaaaaatagagtgcaggctaacaccgtcacagcctagaggtatccggcagtatctagttaaacccttctgtgaatagcccagagacactcttacacaccttcagaaagggacaagttcaaggatgttcactgtagcaataggaggtgaagtcagttgggcttctgggtagggtggggacttggagaacttttgcatctagctaaaggattgtaaatgcaccaatcagcgctctgtgtctagctaaaggattgtaaatgcaccagtcagcactctgtaaaaacgcaccaatcagcactctgtaaaacagaccaatcagcactctgtaaaacggaccaatcagcactctgtaaaatggaccaatcagtgctctgtaaaatggaccaatcagcaggatgtgggcagggccaaataagagaataaaagctggccactggagccagcagcagcacccagcgtgggaccccttttgcactgtggtacctttgttcttttgctcttcacaataaatcttgctgccactcactttttgggtccacactacctttatgagctgtaacactcactgtgagggtctgcggcttcactcctgaagtcagcgagaacaagaacccataggaaggaataaattatggacacagcaagatgtatgatggggttgttggtcagttttagaatccatccctgggaatggggatacataaaatgtgcagtatagagaccatagagtacagtgcagcagttaggtgtcaggaatttaattttcaagtgacatggaagagttccagaaacatagtgtggatgaagatgaaagatgtataatacaacttgatgatgtaaattgaaacccacatgcaaacaaaacaacaatatgcattgtgcaaaacacagaaagatgcacattagcacatttgtaacgacagagggaggtagagggaatgggctatagggatcaaaggaaatcaacataaccaaaggggaacaattctcacacagaccacagcccaccacagaaagcaagcaaaagacctgatgggtctgtgtttttttggatcatctgaaagcaacaatacatatgaagttcagaggtacataattaaattataataaattaatttggattctgaaagcagatccaaaaaaaaacctcaataaaacttcagagtagacacagaagaaaaagaagcagtgaggaaaaaaagctgatttgatgaaatcacccaaagcataacacagaggggtagaggtaggcaatatgaaagaaaagttaggagatatagagaaaagaatgataaattccaatgtctctttaataggagacctggaagaagacgaaagaagagacaatatttgaagagctaaaatctgaaggagattctagaactgacaaacagccagaatccttggattctagaaagattacaagccaagcaggaaagaaacccatgtcttgcctatatgaaactacagactattacagagccagagaaatatattccaacctatcagagagaaaaagattactgacaaagttaagatcgtcgctagaaaatcattacaaaaattctgaaggaaaataaatgtcaatataggattccatctccatttatgttattagtcaaaaattaagcaaaacaaagatgttttcagatataagaataaaagaatgtactactatcagaccttcaccacaaaaaaaagtgaagatttttctttggtactaagagggtgtcacactcacatgtgggatgtcacgtagaaggtgggcattcagccattgtgagccacgtggtggcccagggtactcagctgatggtcaggcctctctcctgattggctagggtccgtgctacacggatcttcacttcagatcatccaccagaaccaatggtgaataacagattctagatctaccttggagaatccaactttaccatgtttaattttttttttttttttcctgagacagagtctcgctctgttgcccaagctggagtgcagtggcgcgatctcggctcactgcaagctctgcctcccgagttcaagccattctcctgcctcagcctctcgagtagctgggactacattaaattaacttttaaagactactgaggcctggtcggggtggctcacgtctgtagtcccagcactttgggaggccgaggtgggtggatcacctgaggtcatgagttgaagaccagcctggccaacatggtgaaaccccgtctctactaaaaatacaaaaattagccaggcgtggtggcgggcgcccataatcccagctacttgggaggctgaggcaggggaattgcttgaactcaagaggcagaggttgcagtgtgccaagatggtgccactgcactacagctatagcttgggtgacagagggagactctgtctcaaaaaaaaacaaaacagactactgagaacgttaaaaagaaggtagattttaaaattgtaattaaaagagcatggaaagtagaaaaaaatcaatagaacttatataaacttccacaccagtagaagaaataaaggaaatagagaatcatctaatggggacaggaaaggcgggtgggctggaagacaatccaagaccaaatgcagtaagtggaaaacacccaatgtaccagaagccaaaggaaaaatatatgtacctacatgactaactaaagaaaaacaataacagattttgaaaagtatcttgtggagcatagctatggtgtttattagaaagaagtgtataggtttaaatgcatttcttttttgaaaaagaaagactggaaacaaattagctcaatattcaatttaagaagcgagaagaatgcagtaaactgaaaggacttcgaagaaagatgataaaatacaaaacaacaaggaattgaaaatgaaagctgtgttttgtttttaaaaagacgaataatatagtatagaaaaacatctcagcaaaacacaaatgatcaatgggaatgaaaaagaagacaggactctggataaagcaggtccttttaaatcgtaagagaatcctttaaacgaagaagcatatgtggtcctctggcagaagctggggaatgcgctgcagcctcaaggaggtggcgggaaacctagttttagtccccaccctcaggactgagaccaccttttgctagttccatgggctgagcagctgtttatggcactttgtgtcaatctctgagccagaagtgttcacctaggaccttttataaatcttatctctgaaactggtgaggtatacactctcatccctgttttacaggcgaagaaataggggctcaggaatgtcaaacagcagagccaggtttgcttagccagttagtgggcaagccaggtttcaaacccaggtttgtcttattccaaagttcataatcctaaactgtagcaactttctcacttcctcccaggtgtgagaggaggggagtggggatggggacagaaactgggagaaagtgtgaggtcagcattgacatttttcttcactctttccaaaatacgactttctgcttttgccagcccagcagaagctatttttcccactgttaggtgggcacatttgctacccaagccttccaggggacacaggtgttagctggaaacagacaaaaaggcattgagtttggtaattcatggctacgagtttattcttactgcctttaaagctatacagtaacattttcatatagaagaatttctttcttttaatttttccttgtaaaaaaaattaacaaagtaacgcaatcaaacatattttcaattccaaagtcaaattgtatcctctaaggataccataaaatgtaatttatttgatctgcttatttttaattcccagatcccatatgctagggagattagcaaatactagtgaaatgtggttgagtcacaaggtaattactttagataaatgtcattctgcagtttaggattatggtcctaaagcccagtatttaacggtacctgattaagccctactgggattggctatatagtcctggggactgtgtataataaaactctataaagtaacatccataaatcagttcttcttcatatattccagtggttgatttcaggcctaaatctgcatcttgctgaagtgttacaatagtgtttaaataatgagaatacttattatttttaaaatgcatccaaaaacacctatatcaaatattttcacggtgagtttcggtttgcaggtttttaattttctgtgagtccaaaaatgggacaaaatatacaaataaacacatactcacatacacagaaaccagattcagagaccaagataactaacagtcccagccgaaaggatcaagagcaacacattcttaggttatgtattataaatatatacacatagtatgtagtaaacatagcttttgtaacaattcccaaaaagtggttttaaagttcaacattaagcatacaaggagagatagcaaattagagacataaacacacataatacatattccaggaatttgcagtcactgggattctgtacatatactatgtacataaagataagacctggagaaaatgagctctggttagagagcatctgcgttttactaataagtacttactagaagttgagatgatattttgaacattgccttactagaagcaagagtgtctagaacacagtgccctatatttggaaacactaagtgaacagaacccatcccctgggccagatggagcaatagatttaacctagtgggaactgtcctttggtaaacaaaggaattgcctttatatgtactgcacactgatatttgagcaatggaaaagcaatccgatatttgcaacagactattaaagtcattactagatgagagatgaattaaacttaccaaaaaattttaggaatcagtaaaaaaatatatatagatcaaggatgactgactatgaatgaactattgaagaaagatcacttcagaattcaggcaagtacaaagtagaatcacaaaaggatgtttagaaaaccagtactgaagtttccaagagatccattttataaatgtaaggcaaaagaaataaacatcctgggcacagccagcaacgcaaaggttaccaggggccagtacacattgtaccatctgaagcactcactgctttttctgggttgaggacagattatattaacaattccagactgggtttgatttccattgatttcgtatctggctgttcaatttccagagagttgtatttgtggtatatcaactttcggaactataacccacaaacgaacccacagacacgaatatgcttctcggcctggtacatggaacacgagctggtcctctgccctcccttcttccaccacacctgactctgctgtccccacctgtctcttcccaccctcacctcaactttaagggacctcagacctaccaggggagtgggaaggaaaaaagagaagaggataaagggagagaaaatgtcctagtttttaaaaaatgccagtttccttttggctggaaaactggttcagaaggaaattccttgagtctttcaaatattcaaggaaactaataaacacccagagtgaaccttaatatacactatgtccactgggtaataatgatctttcaaggcaggttcattgataacaaatgtaccactcttgcgggggatgctgataacaagggaggctgtgcatgtgtgggatcaggggtgtacaggaaacctctgtaccttccactcggttttgctgtgaaatgaaacctactttaaaaaataaagtctattaaaaaaaaaaaaaagcccagatagtaaaggatcaaagtgagtaaaattcagtggcgtttttctgtattttgaaaagcatgatacctctgcattaaggaatgaggcaaaattgccagtgtgcttggaactatgcccccaaaaacctgtaggggaaaacaattctgtatcagtcagaaaagacctcatttgatccccacttcccatatgtgccatggaaaaatccataagaaaagaagcacagagaagctgatattcctcccatgaacttgcctgttggggtcaggttccgctccttggtgttacacaggggcacaggcatagctcacctgaagcaccagtaactccagtttcagagccctagttacctcatggtagaagtaaccaggtcaagcctaggtgataaatgaattacatatattttgcaaatccatctgcaagtcagataaaaggaaccttggaattatctcaagatgtgaagctggagtgttatcagaatgacaaggattgagatcaactttcatctcagaagcgtcggcagcagggcagtgaggtgctagaaaaagcatagaaatcaggaagaatcgcagaatggaagaatgaaagcagagggtgcccatggcgatgtgcggagagctgcagtctgcgaagtgcttttacattcatcaacatcactgttctcatcacacctccctccctcaaagaagcagcagggactctgcaaagtcaggtcagcagggcccaaacatggcagctccctggaagccctgaagagctctgcacagttaccaggtcctgcggagggggttctctcggtccaggaagcgctgtaggtgggagctatgaacctgaaattgtcaaaaatccatcttggtgattctgatgctccacagatacaagaacactgatacagtttggatgtctgtcctctccaaatctcatgttgaagtgtgaccctcagtgttgaaagtggggcccagtgggaggtgtttgggtcataagcgtggatccttataaatggcttggtgccgtcttcacggtaatgagtgagtttcagctctattaattccagagagagtgctcccaagagctggttgttaaaaagagcctggcaccaccctcctctcgctcttgcttcctctcttgtcatgtgggaggccatgtcaccttgcctttcaccacaagtagaagcttcctgagggctcaccagaagccaagcagatgctggggcaatgcttcttgtgcagcctgtagaaccgcgagacaaatcaacttctttttttttttttttacaacttacccagtgtcaggtatttctttacagcaatgtaaaatggactaacacaagcacaaaaagggttggagagatgggaaatattggagctcattagatccatgaagatactctattgagtgttaaagaaaaatgctgcgtgaacccgggaggcggagcttgcagtgagccgagatcccgccactgcactccagcctgggcgacagagcaagactccgtctcaaaaaaaaaaaaaaaaaaaaaaaagaaaaatgcttaaaagaacacatatgcaaaagtttacaagtggtaatagatctacaagtcttttttaaagcacagcaaaatacatgggcaatttcagagaggatctattttttcttgtttaatgctgaatgaagaattattccacccacctctcagcagtagtgactgaccaaataagagggtgttacggtttggatatagtttggcctcaccaagttgtaggtcgaaatttgattcccagtgttggaggtggggcctagtgagaggtgttttggtcatgggagtggatccctcatgaatggcttggtggtgtttttgcagtaaagaatgaattatttatctactagttcccatgagagtgcccctgagagttggttgttaaaaagagcctggcaccttccctgtgctcattttgtttgtttttgtttttgagatggaatttcactcttgtcactcaggctggagtgcaatggcactatctcagctcactgcaacctctgcctcgcaagttcaagcgattcgcctgcctcagtctcctgcgtagctgggattacaggtgcccaccaccacacccagctaatttttgtatttttagtagagacagggtttcaccatgttggacaggctggtctcaaactcctgacctcaaatgatccatccacctcagcctcccaaactgctgggattatagacatgagccaacatgcctggtccgtgctcttttgtttctgttcttgccatgggatctctgtgcagtggctcccctttgccttccactgtgaacagaagcagcctgaagcccacaccaaaagcagatgctggcaccatgcttcttgtacaacctgcagaaccataagccaaatgaacctatttctttataaattacccagtctcacgtaatcctttacagcaacataaaagcagactaacacagaaaatcttgtttgactgttctgtgtcccagagacagagttgattaaggaaaatgacaacactgcatcttgggaaagagtgttcagaagcaccccacccaaagctgttatgaaggagaaggatgtttcagcccagcgctcctcaaacttcatttgcataataatcactagaggatttgttaaagttcaattccgattcaggagatctgggtagagcctgagattttgcattcctgaccagcttccaagtgatgctgacagtgacagacagccttaaggtgcaagatatttctggtgacattgctgtatatatttccaagaaggtgcgagaggtgtggacaaagatccatgcttgaaacccaacttgcccaagaaacacatggaacactaccctgccatgtcaatacttacgcaatcctcagtttgtttctaaagcaaatttctgtacctaacaacacaatatgacagtcttaatagcatataattagacaacagaagaaggctggactctaagtggtagcaaatatgaacatttggggcagtaaccacatcacacagcatctaaaaaggaaaacaaggcactaattccagatacaaaaataaagaagagcagatgagtaattcaaggagtacattagaggacacaaccttttcaaaaataatttttaaatctagtaaaattattatacttaaaataatcttgtgatcaacaaacatacaaaaaaggctttgggagcgaattaatacgtgtaataatctcatcaatgaaacaagggtccattggagaggatatgaaaaaggatatgtatcagagacttttaactgaaaattacctcaaaatcatctaatttgtatctacccgtatttctgatgagaacactagggtcatgtcttagctttaagcatctaattttcatgacaaaatctgggttataactcacataatcacatatttttcccaatacaatgctaatccacacactgattttagtgagtataggttaattacagcatccattcatgttggaaaatgtttattaagttttatacaattttttatcacatcagttaaagaaaaaaatggtgtgtaccccgtaactggctgcattaccaaataagtgggaatgcatagtctttatcacaaaatgttgtttatcatttgataaatccttctcaaattttaagaatgcctttcaataaacatcatctctacttagcatctctgtcattgaaattttatgaaaagtataatcatttaaatagtaagagtaatttttttcagtgatgctgcagcacaagttttagcccaaataaaatatattgtaaaggtcattttctgatgtacaagccagatattcttttttcaagcacttgcaaagcctttgggtgtgagctggagttgaaagttaaacatcaatttgcatttggtttaggaaatccttgtcaccttttcatgaaatttcagctgtctcagtggatttggcaagatcaaagcccagcactcagtcagccccagttttaatccctgccaacagtcatcatttgattcttgagcacaaagagctactactggtgcactgctgcccacagtgctatgacttcatgcggccttgttttcacctgcttccattcagctgggtgcatggcttccaatattgcagagatttgcaaaattggtacaaggagaatctaaactgcagatgccttcagctgccaggcatggacttaaaggcgttcctgatccacatgactcaggattacagccacagaccttggcgggcccctcagctgctctgagaagaggcaggatctacctgactccaaagaacactcacttacaattgcattacctacccctctgatattaggttggctcaaaatcatggattttggcattaaaaggtaatggcaaacatcacaattacttttgcaccaacctaatatatactgtcatatattcaggaaaaaattactttgtgaatgtcacatggttaatatcaacattagtcagaacatctaaagggggaatacccttgtgatgaatcttaaataccgagcaggatggcaaaagtctttataataaacatgaacaaatgcagtaagtttcagcaagtggtgatgaggaaaaactgtggtgaaatggacatttttagagcaacagactctccttgttgaaagcatggaggctgtttacttttgttttactatagattcataaaaagtgatggataaaaatggttgtttagcaaagtaataaataatgataatctaatacaaatatttagtatggaatgctcatgaagattctagtttttcattctcccatgacctagacgaaagaaaaaaagacaggttgttgtttttctttttttctgcatgtattattcaatttgtaaaattctacatgtggaaaaacatttaacaagaaaactgaataagaacaaagggaattatgttgacagaggaagaaaaagaaaaactttattctcattgaaaagaaaatgcaaccatttatgtgaagcaaaatgaatcacaatcaatgatcagtattctgtagccatattttcaggagctggatttttcaactgattaattaggaactcaaactgtatgtgtatgaaaaaaagtagactggggcaagttatttcctgtgacaatcccagccgtgctaccatatccctctccacttctctgtcttgttttccaaagaccatgaaaataactattattcacaacgaaattgcaatcaacaagtcacttttttctcatggggaataatcagtgaagaaacagcaacccaccctgcagctctcacctccaaaatacaatttctatgctttggcagccaatacagtacaattaatgtttaactccatgctttctatctaaacaaaatgaaataataaaaactaataaattagttcgggcacagtggctcatgcctgtaatcccggcactttgggaggccgaggtgggtggatcacgaggttaggaatttgagaccagcctggccaatatggtgaaaccccgtccctactaaaaatacaaacattagctgggtgtggtggcatgtgcctgtaatcccagctacttgggaggctgaagcaggagaattgcttgaacccaggaggtggaggttgcagtgagccgagatcacaccactgcactccagcctgggcaacaaagcaagactccatctccaaaaagaaaagaaaaaaacacacaaaaaacaaaaaaccaactaataaattaccacccttttaagatataaggtatcataactaaggaaagtgagactagaagcttggcatttttgaaatcatctttggcaatgtatatgacatcaaatgtacatgaatagtgaagaatggagtttgcaatctagcatgtgcggtcattacaaaaccatcctcactgctaaacttctgcacacaaactatttgagaatattagatttattacactgctttgtcctctggtagcttatgtctggataacatagccaaaaattatgtacaaatgaactggctcactttttttaatctgtcactccaagttaacactctcctctcctatcactcagcagtttcttttaagatgtaaaaataaatttaaacctaataactcctcttcctgagaactgaattggtagatattgtgtcttcaatcaatgggaattagtaggcagtttccgtcattttgtaagaaattccaaacactgaatatgaatctccaatgtaactaagaaatagacccaaagtgcaacaggatttttacccacagggaagaccaagcctaggctcaaaggcctagattcatatcccaggtctgcgacttacatggaagtatgtaaatataaaatattaacatgatatggacaatggcactttgataaatgcaagattcgaatatcccctatttagtgctctatcattaggtccactttcttaacccatgcttgggccagaggggcacattaatgagccatggagcccctgcaggggttctgccccatgcatttacagctggaattaaatcccatctccaccactctgctcccagtgtgaacatggggaaagttgattaaactctctgacttcagattcctcatgtaaaatgtggggaaacagctctgacttaatggtgtcactgtgaggagtaaatgaggtaacatatttaaaggattttgtatagtgctggtgacagtaaccagccaatagatgatatagctagtaatagcaataataatgtcacttactattactttaaaaaataaatctcaaagtcaaaaatactaagaaactaacaagagactatacttgggtctcccttttgtaacttttgaacattatctcacttctgaaagtcctgtaccaatattatcctcctcatttctcaggtgaagcagcatcttagaggggtattgccctgtctaaaccatctggttatcatggtgaggtccaggattcttccctttcctcatctttgccttaaaaacatgtattctaaccaactgccttagtttgtccaggctgctataacaaaatgccatggcttattgatatggtttggccgtgtccccacccaaaatctcatcttgaattgtaatccccattatccccataatccccatgtgtcaagggagagaccaggtggagataatggaatcatgggggcagttgccccatgctgttctcgtgatagtgaaggagttctcacgagatcacattttttttaggtgtttggtagaacttcctgcattcaatctccttcctgccaccttgtgaagaaggtgccttacttcccctttgccttccatcatgattgtaagtttcctggggcttccctagccatgaagaactgtgagtcaattaagactttttcctttattaattacccagtctggaaacagaataatacacttataaacaacataaatatttttcctcatagttcaggaggctgggaattccaagatcaaaattccctcatcaccattgccaataaagtactgagtatccacctgttacctaaacacgcaatactagttgttatataaagccatttgttaaaagcctccttaccattcgatataagtaaagaggaaaattgtatgttaacttgttttctatcccagtatgacagacatttgaaacagataaaaggagtgtacttgtgagggtatgttatattgtgtggaatagaaagtgtccactagggttaaatttcttggaataattctattaaaaatgagtttggaaagaacaaagtgaggtaacaaggtataaatatacataaactctagggttgttcccaagaagtggtcatagttataatagggacaaactgaattctaatttaatatttttcacttcaatcccttaaccatatgccaagtatacgttggcaatacaaatggcccaggctatttggagaaaatgcattcgatttctaatagcttaccaataatatgtattagcttgttggacccattttacaaatgaaggaattatgtgtcatagaaactacattatctgcccaagaattaaagagcaagaaagggacagggtcttactttgaccttagccaggactctcccccatggcccagctgccttctggcattcagaattgctaaatgtgtcacatttaagaaggtagtctacaacatcctgctggcattcagaattgctaaatgtgtcacatttaagaaggtggtctacaacatccaggaaggcagtaataccccattaaagttttagagctaagtacaattttgttttctttttcaatctgacttttgcatatataaaatgttaaatttttcaggtgagaaattactctgataatgcaattagtctgtaaggagtttaggtagttatcctaaggcaaggtaacagtaaggatacttcaaatacttgaaatatctgataaactatattaactcaatatctatcaaatatcacatactcatatgagcttgtatgtcttatttttaataagttaaagagactcaaataggaagcaaaaggtcaagttattatttggttttggacaatggcttcctgctccaattgaaataaaatgtaaagacctcgctatcatttttaaggtgtagtggtttcacccctccctgtctctcccacttcactgaccacttccttaactgtccactccgaaacaccccttcttcctgttcttccaatacaccaaactctttcttgcctctgtgtgcttgcccatgctgttccttctggcttcttccttcacattcaagtcttgacttagatgtcacttgccaagggagaccttggagaacccttcctgaccatctcatccatcaccctcaccccatgtcatctctacagcatcactctgggttattttcttcaccgcacttgtatcaccatggattatatgtttattgtccttccctctcacagaatataagccccatgaagacacagatcgaattctaacttattgctgtccccagcccttaagagttcagaagaactcacaagcacgcacatatttgttgagctaatgaattgcagatattgtaccagtgattaaatggaaacgaggttttaaaagatgcaaaacaaaatacatttgacgaagttaaatgtttgaagagccaaaatagtttctggattagagttcaaaattagtactaaaagtattttctgccctaaactgaagtgtggtactgccttagaaacctgttaacttaaactacactatttaagagttaaagcatatgttttatatattggaacttcacaaaaaaggattttttaatttttttttattaagtctgtgctattaataattcttgaaattgttggtccttggaataaaggccaaactcctagacttatgtcatggttttgtagcctcaactatcagcattccaatccttcaccttttcatgatgtttctcttttttttttttcctctgtttttgagatggagtcttgctctgtcgcacaggctggcaggcagtggcatgatctcagctcactgcaacctctgcctcctgggtccaagagattctcccacctcagcctctcgagtagctgggtctacaggcatgctccaccacaactggttagttttctttgtatttttagtagagatggggtttcaccatctttactggtgaaaccagttggccaagctggtcttgagctcctgacctcaagtgatccacccaccttggcctcccaaagtgctgggactacaggcatgagccactataccaggctatgatgtttcaatattataaaactatttaaaattatctgaaagcatcatgtatcatggtcatgagttcctcactgttattttactattcagagctagaatgctcagtctgagccagttcagcttactttacacacaggaaatggaggttgaatttccaagcgaccgagtgatccatttctgatgttcatcagtaagtcagacttacatcttaaatagctgctaacatttgctacctatctacagatgttttccgctaaatctcatgttccaaaatagaaggttttaatcgactcctatgaacacaggttaaatagcatattttgttgttgttgttttcgtttatgctttttcagaaagttacttaggtccattcatttatccccctatatttgaaacaaaattctgctttcttacaagccccttttcagttaatctcaggtggctatcatacttaaaattgtggagaattattttcatccataaggcctgtaggaagatgcccctacctcaaaacttattgggataaagtcaaaaaagggtcatcctcttaaaggtaaaacaggaaaatattaatcaatcctagatttggaacaataatacactgtgcaatagagtctggacatgtgtggctggtgggtggagattctgcaaagccatgagtccctggaaggtaaccagcagactaattttacagtgtgacatagcttatcacaatagcggacaggaacctgggtttaaagaggactcacttgggcagtaatcctggcctgtcgtttcaggaatatgaccttgggcaagatacttgtattctttgaatctcactcttatcatctgaaaaataaaaacactaacgactgtctcaagactgctgtgagtattcaataaaataacagctgtcaggccattagttagcacaatatttggcacagggtagggggtaataaagagtagccatagagataatgttgggatgatggcctaaagaggatgctggagcacagttaggtgtgaacagagggtcgcatgccataatcataatcaataacttgtagataatcaataacttgtatgtagataaaaacttgactgtctacagtaacagatgtgggctctcaactgggtccagcaaatggaacaaatgattgtgtttttggtgttactcaggggaggggaggctgatgccaagacagtaacctcagtctttgtagagggaaccccatatgctaaagagatatcgcttgagaatgtttcatgctcttgagcccaattctatgtgctccctgatggaaggacaggtaggtattgggtgaggtgagcaaccaacacttactgggtgcaccttcaaataggacaccttctgaagtccccctagcccaggcagcacagggcaggccttctttggtgccaccaagtgcaattgtgtttccttcttattttaccatctgctatgcatttctttccatatccatgcctataattccatgagtttgggaggctgaggtaggtgaattgcttgagcccaggagtttgagactagcctaggcaacatggtgaaaccccgtctctccaaaaaatacaaaaattagccaggcatggtggtgcacacctgcagtcccagctactcaggaggctgaggtgggaggatcacttgcgcccaggagatcaaggctgcagtgagccctgatcacaccactgcactccagcctgggtgacaaagtgagatcctgtctcaaaaaaaaagaaaagaaaagaggaaggaaggaaggaaaagagaagggaagggagagaagagaaaaaagaaaagaaaagagaaattgctagggaaaggcacatactgggtttccaagagccatctctattcgaaggtgtgcaaaagactcccagtgcttaaaggcccagccaagctctgccctgaaggccagggtgctgtttgcctcaggaacgggaacacaacctttgtagctgaaagtcagctcttctgaacctcctcacataaaacacttatcaacagaaaagatgaggcacaacctaaccacatactctggttccaatttataagaggatcagatccaaatatagtttattacattgaaagggatgttctgatgagaatccatttttaaaagaaaggaaaatagcaaagaagcaagcaagttgtagcattactacagtctttggatccaaacatcgcgaatgagaaatgctttaggcaaagtaaaagttttgacctgaatgagacgaagtatcctggtacctaaagtcatccctgttggtaatgggatccacaggcggcaaactgtggcctctgtgctctgtgtgagtgcatgtgcgtgtctggactgattcttaggccctgctggcctgtggttttcctttgcgcaagaactagcacaaggcagagcactaggaccagcctgttttctctgcagtggtttgctgagcccatgctctgggggtaagccttaaaatggcacatgagcttgtagcaagaaggaccctaatatcgtcacatcaacacggctgactcacttgtcccctaataatagacaggtactacctagaaaagtagatgttttagaaaaacactaaagatatttttatatctgcaggatcggtaccactctccagctttctgatacttgctttcaaatataagagtgcttcccctacatgacacctttttaaggaaggactaattttaaagcatattagagcccatattctgatattcattgacgggtgggagttgatgagcgtaaggtgactcagaggccctcaatggccatttttgtcaaagagcttattgaattttgtgggtattattcagttagctaaaagaaaaaacatcttatctactcagagttccacagcacaaagaaccaaaagttctttcttaattggagaggttggaaagtataattatgccgtatgcttggcaggtaaatatcttaaaaacaagaacaacagaacacagaattgtggtaatttcttgcaacaagaaaatgtcttgaagatgacctacctcctgcacccctgaccatactgggtgatacgaaatgtgcacattaagaaaaactagtgaactctatttagataattttaagggaaacatagaatgatttttatgtgatctacgacctgaccacattacagttttatagctgaaaatcactcttggggaaaaataaaatagctcccagtttcctcattttacaaatatttcatatatatatatatgctcatgttcctcagtattccagaattcatcaaaagataataggtaaggcagcatgatgttatattaaaaataaaataaacagcatcatcttctacacttgtcttttcccttaaaatgaaaaaatgaaagtttataaactcatttgtaattaagattatagctgtttacaaatatttttgctagttaattttaccaacccaattaatttatcacattttcagaaacccaaatctaataaaacacactctcaataaatagtaagcactcacaacataatgcatatatttagccgttatttctaagccaggttggctattactagcttcaactaatttttgcctgactggagggcactgctacaccctgagagcaatattcacagggtaaagaaaaataatctacttttcctacatgaccttgtgtatttcatatttatgttttatttcttgggaaaatatcttcttcaaacgaaatgtctcctttgttggtttaatgacagaaatggggtactaagtatttcacagagttttaggataaaaaggttcatggttctaaatcaaagtttgcaagccggttttttttttttttttaacctatcttttttacagtaataggctttttttttttttttttttttttggagacagagttttactctgcctcccagcctggaatgcagtgacatgatctcggctcactgcagcctccacctcctgggttctagctattcttccccctcagcctcccaagtagctgggactacaggtgcccaccaccacgcccagctaattttttgtgtttttaatagagacagggttttgccatgatgaccaggcaggctggtctcaaactcctgacctcaggtgatccatccgcctcagtctcccaaagtgctgggattacaggcgtgagccacagtgcccggcctatttcttagaacagttacagatgtatagaaaaattgaggcgatagtagagagagctcccatgcactgtcccctgccactcccctatactcaacttcctatattatgaacatcttgcaacagtgtgaggaatttgctgttaactaaaggccgcgatttacattaagctgtactctgtgtgttgtacgttctgtgccttctgacaaatgtataatgtcatgtattcaccatgctagtgccatgcagaatagttttactgcctcacaaatccctggggtttgtcctgttcatctttccccacctgccaccttcacatccctggcagtcactgacatttttattgtctcagcatttgccttttccagaatgtcatatggttggatccacatacgatgtggctttttcagacttgctttccttgtgtggctgtatgcatttaaggtgcttcctgatctttttgtagcttgatggatcattcttctcatcactgagtaaaagtccacagttcactcactcagttgctgaagaacacttcggttgattttagttcggttgcctttagtaaacattcatgtgcagatttttacggggaaataagttttcaaattatttgcatgaatgccaagaagcgtgattgctggatcctatggtaagactatgtttagtttgtaagaaactgccaaactgtttttttttttttttttttttttttgagatggagtctcactctgtcacccaggctacagtgcagtggcacgatcttggctcactgaaacctccgcctcctgggttcaagtgattctcctgcctcagcctcccaagtagctgggattacaggtgcacgccatgacacccggctaatttttgtatttttagtagagacaggttgtcatcatgttggccaggatggacttgatctcttgaccttgtgatctgcccacctcggcctcccaaagtgctgggattacaggcgtgagccaccgcgactggcccaaactgtcttttaaagtgactctgccgtctctgttactccacatctcatcagcatttgatattgtaagttttttgaattttagccagtttagtagctatagagtagtatctcgttattgttttaatttaaaattatttaacgacatataatgctgatcatcttttcatatctttatcttccacttctgtgtcttcttaggtgaggtgatcttccagatcttttgttcttttttaacattggatcatttgttttcacattgttgagctttaaggctgctttatatatttggatacaagtctttttccaatatgtgtttcacaaagattttctctccatctttggcttgtcttttaacgttctcaattgttcaattgtgtcttttgctgagcagaaggcttttttttattattattattttactttaagttctgggatacaagtgcagaacatgcaggtttgttacataggtgtacatgtaccatggtggtttgctgtacctatcaacctgtcatctaggttttaagccccacatgcattagctatttatcctaatgctctccctcccttggcccccaaccccctggctggcctcagtatgtgttgttctcctccctgtgtccatgtgttatcattgttctgggacacagctaaagcagtgttaagagggaaatttatagcactaaatgcccacatcagaaagccagaaagatctcaaatcgacaccctaacatcacaattaaaagagctagagaagcaagagcaaacaaatccaaaagctagcagaaaacaataaataactaagatcagagtagaactgaaggagatagagacacaaaaaatccttcaaaaaaatcaatgaatccaggagctggttttttgaaaatgttaacaaaatagatagattgctagatagactagtaaagaagaaaagagagaagaatagacacaataaaacacgataaaggggatatcaccactgaccccacagaaatacaaactaccatcagagaatactataaacacctctatgcaaataaactagaaaatctagaagaaatggataaattcctggacacatacaccctcccaagatgaaaccaggaagaagtcaaatctctggatagaccaataacaagttctgaaattgaggcagtcattaatagcctaccaaccaaaaaaagcccagaatcagatggattcacagctgaattctacagagttacaaagaggagctggtaccatccttctgaaactatttcaaataattgaaaaggagggactcctccctaactcattttatgaggccatcatctcctgataccaaaacctggcagagatacaacaataaaaagagcagaagtttttaaattgaaggaagtcaaactatcttagctagcttgggttgctataagaaaataccatcaactgggtaatttatgaacaactgacatttctcacagtgctggagactggatagtccaagatcagggcaccagcagatttgctgtcttgtgtggagctgctttctggttcatagatggtgattcttgctacgtcctcacatggtggaagagacaaggcagctctctggggtctttattatatgggcactaatctcattcacgagggcagagacctcatgatttaatcacctctcaaaggccccacctcctaagactatcacaacatatgaattttggggagacacatacatccagaccatagcaccaacttattaatttgtcctttcattcgtcatacttttgcggttgtatctaaaaagtcaaaaccaaacccaaggttacctagacttcctcctatattatcttttagtagttgtattgttttgcactttatatgtgggtctctaatcaattttgagtttttttgttgttgttgttaaagcacgtattgtaaaatatttgctaaattttgtgtctagtttctttcacacatggattttcaggtgttccagcattatttgttgaaaagactatcctttccccattgaattgtctttgttcctttgtcaatattcagttgaatatatttgtgtgcatctgtttctgagccctcattctgttccattgacctacttgcctgttcttccaccaacaccagaagctagtgattaccaaaagtcttgaagtcaggtaatgtcagttctctcatggttcttctacagtatctccttgcctattctaggtcttttagctttccatgtaagctttagaatcagtttttcaatgtgtaaaaattggcttgctgagattttgattgggatgactctgaatctataaatcaagttgagaaaaactgacatcgtaacaaaattgagtcctgtccatgacaatagaatctctctccatttctatatatcttgtctatttcattagagttttgtagttttcttcatgtaaatactgtccagatgtagttagattaatatttaagtgggttttttggtgctaatagaaattatattggtttttcatttcaaattccaattgtttattgctggtacattggaaagcaattgactttcatatattagtcttgtatcctgcaaccctctatgactacttattaattccagaaatttttttgttaactgtttcagattttcaaatagactaccatgtcatctgtgaacaaggacaattttatttatttcttctcaatctgtatatattttatttccttttcttgccttcctggattagctcagacttccagcacaatgttgaaaaggagtgatgaaaaggaaaatcttttacttgttccaatcttagagggaagaaacttattttctcattattaagtatgatgtctgttataggttttatgtagattcttttttccaagatgaggaagttcccctctattcctagtttgctgagacatttttatcataaataagtgccggttttaccaaattcttttttgcatctgttgttatgatcatatgattttcattcttcagcctattataatgcgataggttacatttcctcattttctaatgttaaagcatccttcaatacctggaataaatccaaatgcatcatggtacattattctttttatacattgttggatttaatctgctagtattttattgagtaattttgtatctaaattcattagagctattgatctgtagttttcttgtgatgtctttatctgttttggttttaggataatactggcctcatcaaatgagttagcaaatgttccctctgcttctactttttttttttttttttttttttttgagattgggtctcactctgtcacttagtctggagtgcagtggctagatctctgctcactacaacctctgtctcccaggctgaagtaattctcccacctcagcctcccaagtagctgggactatagccatgtgcctccatgctcagataattatttgtattttttgtagagacagggtttgtcatgttgcccaggctggtctggaaatcctgagctcaagcaatccgcccgctgcggcttctcaaagtgctgagatcatagtcatgagacataacgtcagctcagcttttatttttaggaagagattgcaaagaattggtatcattttttttctttaagagttggtagatttcactagtgcaaacactggtgcctgatgctatcttttttggaaggttattaattattgagtcaatttctttcattgatataggcccattcagaatatctgtttctccttatacaaatcttgatagtctgtgtccttcaagaaattagtttatttcatccaagtattcaaatttatggctacagggcttttcataaccctattatccctttaattattatccttttaacatctatgaaagcattcctgatgagttctcttttatttccaatattaataattcatgtcttctttttgcttgatagccaggttagaggtttaccaattttattgacatttttaaagaaccagattttagttttgctgattttctctactggtttcctggtctcaatgtagctgatttctggtctaagttttattattttctttcttctgcttgttttaggctgatattgcacttcttactccagttttctaaggtggaagcttcgactattgatttcaaatcttttttcttttctaatctatgcattcaatgttataagttttctgtgaagcagtgatttcattgcatcccacattttgataggttatattttcatttagttacaaataatttaaatttcccttgagatttctgctttgacttatgtgttatttggaagtgtatttttattctccaaatatttagagatttgcagctgtctttatgttattaaatttaattccattgaagtttaatttcattataatcaagaccatattttatatgatgtctatgattttaattttcttgagatgtcttttatagtccagaatatagtcttggtgaatagaccatgtgaatttgtaaagaatgtgcattctgctgttgttcatgaagtattctatgaatgtaaattagattcagttgtttgatggcattgttacataggtcaactataaccttactgattttctgtctgctggctctgttaactactgacagaggggtgctgaagcccctaactataacagcaagtttttctaattctgcttatgcattttattttactgtcatttattcctacgaaactcctccttttgttatgtaaatctgaatttctgacccatgctattttcttctttctgaatacattcttttaacctttcttaaatgttaaaggcaggtttactggtaacaaattccctcaatttttttgtgtctgacaaaaatctttatttctccttcacttttgaagaaacattatgtagacagagaattctatcttggtgggttttttgttgctgttgttactgttgttgttgttcaatactgtacatttcactccactctcttacttgtgtagcttgtggcaaaaagtccagtataattcttagctttgtctctctacaggtaaggtgtttttctctggcttgtttcaatattgtctctttttctttagatttctgcagtttggatatgacatgcctaggtgtagacttttttgcatttcttttttttttttttttttttctgagcctcttggatatgtggtttagtgtctatcattaattttggaaagctgtcagctattgttatttcaaatatatcttctgctcccttttctcctttttctgggattctcattctgcatgtgttataccttttgtaattgtcccagagtacttgaacagtctgtttctatttttccattcattttttttctctttgcattttggtttaaaaagtttctcctgacgtatcttcaagctcattgattctttcttgtttatatctagtctattaatgagctcatcaaaggcactttttatttctgctacattgcttttgagttctagcacctcctttaaattcttccttagagtttccatttctgtgctgacattatccatctgttcttgcttgtcatctacttttcctattagaaccctaattctgttaatcatagttaaattccatatccaataattccaaaatcactgccatatatgagtctggttctgatgcttattctgtctcttcatatgtattttttcttgcctttcatttcttgtcattatttgttgagagtcagacacagtatttgggtaatgaaagctaatataattagacttttagcatgaggttttacatgaatctgggctgtatttaatgtttgatgtagctgcaggtgacacagcctttagtttctttatctcacttttctctcttgttgtctttgtgtttccctaggaactcattcttgaatagaggctgcatcttgcagctctcttagctgtaattcactggtattattttggagccttgttgatgtgatgctgaggtgttagggagaggaagctctccatactcttaagataaaatctcagcttgcagtatacccaagtccctggattgtgactttcagatgtgctttgtggttgtgtttatttgtttgtttgttttttagcttttcttcctcctcctatgtgaggcaggcaggatagaagggggcaccagtggctaattttcctttcctcaagttggacaatgttctggtaaggtagccttccttgaaggacatggttttcttatagagaatgcaatgggcttgcttcaaatacttaccttctcacttcccatgctcagaactggaggggatttttctctgaccttcatgtgagaatctggtgagcttcctggaggaaaaactcaagaaagctgtaggggctcctaggaaatattaactctcaagcctcacatacttagtctccagcaattcattgaacttaccatttacgtgttcctaccaatcactggctccgcaagcttctgccccctgtaagctgaccttggctctcattctctgtgttgacctgtctctccagattgcagaccagtggtttgccctgtgacctcaatcctctgatgaatccagaaaagtcatagattttcattctgttcagctttttttcatgttatgagcccaggagtaatcacttccaagctctctgggtgccctcgctgaaaatcaaagtcagcaaactttttcttacgaagggccaaatgataaatatttttggctttgagagatacagagtctctattgcagctcctgaagtgtcctattgtaatatgaaagtagccataaacaaaatgcgaataagtgaacatggctgcgtcccaatacagcttcatttacaaaaaaaggggttgggccacatttggcctgtgagccccattttgctgatccctgctctatacaggctacagaatgaaaggccatcaggggccaagacattagtaaacatgagcaaaggtgaatgggttttaaacaaaaaatatgttcttcacttatatatgtgcttaatgcacattctttttttttttttttttttttttttttttaagacagtctcactgtattgcccaggctggaatgcagtggtgcagtctcagctcactgcaacctccacctcccaggttcaagctattcttctgcctcagcctcccgagtagctgggattacaggcatgtgccaccacgcccagctaatttttgtatttttagtagagacagggtttcaccatgctggccaggctggagtcaaactcctgaactcaggcgaaccacccaccctggcctcccaaagtgctgggattacagatgtgagccactgtgcccagccaatgcacattcttatttccataaaaatgttatatttcatttttctttaaacaaatactctactttagataggaatatgaatatcataaatcatttaatgcttctgaattataataaagagacagccacacaattggcagctggtactctgtctcagtgttggtgttggggccacgagggggtgatggggacattgatgagctggagtgaagagcaccaaagccactgctggagctgccaggtgggaatgagagcctgcattgccagatttataattcttccagaggagctggaaatccagattttatgttacctttaaaatgtttagtgttggcaactattcaaaataaatttttaaacattgcccaggtcaacagtcaaacacaaatatttgtcaagtacaaatcctctagctggctaacattggctggcttgtggttgaatttggcctccaacccaggccagccccaagttttaccaaacgggtgcatgggagttaaagaaggtgcccaaggtcacacagccaggagacagcagagtgtgacctgggctgtagtagctgagcagcccacttctgtatgcgagctcacagctcagagcaaatgtaccttttagcttccatggaatgaacatctctctgctctgttttcagtctgatatggtttggctgtgtcatcacccaaaacttatcttgaattcccacatattttgggagagacctgctgggaggtaattgaatcatgggggcaggtctttcctgtgctgttcttgtgacaatgaataagtctcacaagatcttatggttttataaagggcgagtttccctgaacaagctctgtctttgcctgctgccatccttgtaaaacatgacttggtcctccttgccttccaccatgtttgtgaggccttgccagccacgtggaactctgagtccattaaacctttttcctgtataaattacccagtcttgggtatgtctttattagcagtgtgaaaacacagtcccaccactgagtcattttcttccactgatattaagaatcctcgtgtttacattcttacataccttttcagaaatcaactaacttcacactcttttttcaaaaagcacaattatgtttcagttaatcagcaaaaagaactaataaaacaatcacaattatgcctgtgctgtgaaatcacagcaagataaatggttccaatcagtcaaaggaattctacaaagaacatcatatataagaaatgtgcttcaagttatttggatccaaatttcatatgcctcattctccctttaattctgattttttttttttttttttttaggaaataaattccatcttttcagggatttcatctttttagaaagcgatattctttctttaggggaaaaatgaaaagaagcatgatatggtttggctgtgtccccacccaaatctcatcgtgaattgtactgccataattcccacgtgtcatgggaggggcccggtgggaggtaatggaaacatgggcgggtgggggtttccctcacactgttctcatgctactgaataagtctcatgagatctgatgtttttataaggggtttccccattcacttggctctcattctctcttgcctgctgccatgtaagacgtgcctttcaccttctgccatgagtgtgaggcctccccagccacgtggaactgtgagtccattaaacctctttttctttataaattaccctgtctcgggtatgtctttatcagcagcaaggtaatgaactaatacaaagcaattggttagaatattcccacattgagaggcgccattccataggtgccactttggatggagaaggaagttggtacagggccaaggtcccttctcagaggctgcagtgaagagtgagtgaggaaggggggagtttcaggagggccctggcttgctcttggtgttgccatcactcttgttcctgtgatccagagatcttcaaaagacagaattatcacctctaaagagcaccataaatggtaggaggagactgattataaaatatacataatcctcatgaattctgctgaagtatttttctagtggcagtgagaaattatcctaaaaacgtgatgacatcacatctcattctatttcatggctacaattttgaaatgccatagcagtgtatttttctggcattagggataaaaattaatattttgaaaatatatttgaaactgcaaagaacagcaaaatatcctgtgattatatgcaaaattaaaattagggagaaatggttaggtgtgttgagcagagtaacaaaaaagaaaccgtgccattgtataccaggtaacattgtatattttctcatttcctaaacggtgttctaaggaaaaataagagatacagctcaaaataaactgttttgtgcccagataagctctggaaaaggttagctgaagtgaaacaggtgtgttgacaacagaatatctcagcacttttagtgtgcttgtatgcgttgtattcttagtagatctctactatgaggtatttttcaagtctattgaccatcaaagcccatattcaaatgcagaactttcaaactctccctgagaagtatttaatggaacacaatttgggaaacattgattcattttaattgttgggaaatttaaataaattcacatatttagaaagttaactttgcaatactcttaaaggatacaacaattttggtttgaagtgtaccagggacctcttctcttctttaaatttaaggttattaattccaggagctaccactcgttttcaccctgggtaatttgcaagttctttctgggtaaagtgttttgaataagttgaattgcttcagattgttattaattaattaattaattttgggacagggtctcactctgtcacccaggctggagtgcagtggcacaatcatggctcactgcagcctcgagctcctgggctcaagcagtcctccatcctcaggcccctgcatagcttggactgcaggtatgtgacaccatgaccagctattttttgtatttttagaaaagatgggattttgccatgttgcccaggctggactggaactcctggactcaagtcatctacctgccttggcctcacaaagtgctggtactacaggcatgagccaccgcgcccagcctgcttcagatttttaaatcacgattttgccgttgttgtttccccagatgggtttagaaagagtgaaactatgcacatcatatgaaattttcaatgccagaagaagcaattcaacaaaattgttgccataaaatttgtactggagcaagatagaacacctgtttagttatcaattaataccttttcattatgttttgcctggctttctgtctcctttgcctggctttctgtgcaatgatacctgggctagggttatttatgatttgtagcaaggacggcaattaagatttatgcttgtggggaaatgcttggcatctctgctctgtgagaataacacaaggtagtgatctttctaatcctgcagtgtggaagggatgaacttctgtgagaaaaggaaagatgactcaggaaggggagagcattgttaggactgaattgttggggaagatggtaaaaaagatgttgggaaatatcaactggaggagaggtaagtggataaaatagaaacccttattagaattaggagctaatgggaggccagcatttgctttgacagaggacaggcaggccttgcctgggaaagtctagctccaggatgggcagatggtggtgagactatcacggctgcctcaagctctggttagattcttattactcagtgctcttatatcaagatgattctggtgacagtccaacaaagaggtcacagttcacgtgggattaatttaaaagaggccacaatcctgcctcatagggagacggactatttcttaggttcacaggatacctttcttgacaaccaaacacctttaaaacaagcacggggcttgggacatagtccacacgaacatctcgaggattctgggctgagaaacagcatatttaaatctctcatcaaaaatgaaattcagaaagcccagcgagacaatatccactctttactgtagaaagaaaaaaatgcccacatttctgggaggaaattgcagaccatctgctgccctgacggccactcggtgtacatttctcccctccatctcggacactgcacccagccgttgtggacctgaacttgtgtcctacctttggtttgccccttcagcaaactgagcaaactagagaaataaggcaaaccaaggaacagccctagatgtctgtaaagagcccagcacgggctgcccatgaccctggggctggcaaggccccatcccctccatcagagtagaagcggcttccagcttccggtgggaacatatgtgcttatacgactttatgtgtggggctgtgtgattctgccaaagtgcttgaatttggcacttctcctgtgtctgattccatcccctcccctcccccaataaaaatgcacttccataggctctgcctctaatctgcataataagattcagttttacatgaaccatgtccacgacctcagggccaggcatcagggtggccgtcacctaatcatgtttccctaagtgtgtttcatgggaggtgaatatccaaggtcttaaaaagatgagacctatgcaaggtccagtcagctttgaaatgcactggcttagagttaacagcagttttgctgcaggacttctcagggcttttgatatgttcattgcaaaccctctaaagagtgagagtgcttgcagaatttctccaagtacatttcaccctagaaccttctcttcagagcagctttgtcccacaaaatataacatgagacataaatgtgaactgcatatgtggtttcagattttcaaaaagtcatataaaaatgtaaaaagaaacaggtgaaattagttttcaatttttttttttttttttttgggatggagactcaccgtgtcgtccaggctggagtacagtggcgcgatctcggctcactgcaacctctgcctcccgggttcaagcgattctcctgcctcagcctcccgggtagctgggactacaggtgcacgcctccacccacagctaatttttgtaattttagtagagactgggttttaccatgctggccaggatgggctcaatctcttgacttcatgatttgcctgccttggcctcacaaagtgttgggattacaggtgcgagccactgtgcccggcctagttttcaattttaataatactgttaggtaacacagcgtatcaaaactattatcatttccacatgtaattcatatgaaatatcaatgagacaattgataccctttgatgtgacaccatgtctttgaaaaagggtatgtattttatggcaccctcaattcagaccagccatactttgactgcccaacactgtgtgtggccagggctaccctactggatggtgcagatccagcatgtctcaggagactattatttcacaaagttggtgtcatttgagatgcacaggtaagcactctttcctaaggttggctaatgtaatgttgactcattagtaaatatttagtaagtgccaactgtgtgcaggacagttttctaggtgctatgcaaatagctctgaaccacacactatgcccttgccctcatgggacttcagtgaagcatatactaaatcacacaactaattatttgataattctggatgctaagacagggaagcttgactgcacccatgggtcagtggaggttgcccctactaagtgacatttaaacagagacttggaagatagcttggctttagctaaacagtgtgcaaagagaggaacatgaggtgggacaaccaccatagttagagaaataaaggatcagtggatttgaaatacacagagcaggactcagagagcacattgtgagatgagtctggtcagcaggaacatacaggctgtttggggtgagtgctggattctatctgaaaagcaatgggaagccttggaaggttgtacgcttagagggtgacatgatccaacacgattttatagaaattaaatatgtcttcaagttctttgctgctctgctcattgagatttataatttaattcccctctctctttgaattctgactggtcctactgacttgcttgaccaagagaatctggtggatgtgaggtcctgagatctccaagttcgggtccttagaagccttgcagtccaccccagtctttgggagaacattctcttgaagccctgaagtgtgactacccagaaagcaccatgctagagatagcatgtggatgggacacttggcaatgagctgaagagaagcaaatatcagctcatgaatgacaatgacctctacaaatcccaagtcagatttgccgcgaggagaaagagatttctgtctactggccattggtgtctacccagcagaggtcctaggcatcctggagcagacgggagttgctccactgagtcctgtccaaatctcatgtttacaaacatagccaatggcagttttaaggggatgtttgttatacagcatgaggatgtctgttatatgttatcaaagggttttgataatccctctggctgaagtgtggagatggacaaactgcaagggaagaaggacatgtgtggacaatagtaactgaaccagaatgtggcaggaatatggaaggcagtggctgagtgaagacacactgagaggtcaccctgaaaaccctccctgtcttggtagggaggggagattgttgttttctccatttctgttttctcctccttcattttttctttccaggttcaagaattaagacaggaatctttaatccttgtccctttactgtctttcccatatgttttcaagttggctcaagagtattggtggccacttgaccaagagagtaacagatagatggctgtgacagatggtgtgtagtatgtgatgacgaaaatctctattgattcagcctcagaaagaatatttgggtttatctgaaaactgcacatcatggtcaagtggcttaaaaataaaattaagttagataaagattaaaacatatactctcacctcattgtagctaattaaaagtcactaaaatgttttaaataggaacaaacattattaatggcaaatagggaaaagtgttcccaaaaacctaactgacattccattgggtacatttgtctatggtttgtgcaccaaagcaaagccacatcccagcaccactttggaaaatacatatggaatgctgtttcactggttcatttaacagtgatattttcatttgtgtttatctatagtggttttatattcctaattcttaaaaaaaagattttttaaaaattgtaacatctaaggcaaaattaaacaagagatttctcagaagtctctaagaaaaccttctgtcctgtgcctcattaattcatcaatataatgcaaattaattgccactgcattaaaaaaaaattgttagaatagagatccggatgtaaaagttgccctagcatgccgcactgctgagacgagctattacagcccacttttccacttcactttagggggatctgtagctactagttcttctttaggaagtaaaattggctgcacctgggcatattattagctgctcaccacagggaatctcatgctgatgggctataatttagcagagaaggaaaaaaaaaaaaggcaatccaattaaaatgaagcacatcacttggtgcccatttgctgattgcttgtcagaatctattatcttgtatttaacaaatatgggataattagaaaaggaatgagtatgagacaatcaaaatttggggagcaaatcgttatccttgcacaaaagaaaaactctgagtcctcctaatccatcctatcaaaggaaaaaagcacacccatatattcccctgtgagatgcacagataatttgagaagactcctgtcaaccagtcccaccccagtcccaatcctggcactgcccccgggggcccagcctaaggtggcctgtcctgctgagtgcagccccaggcctcagtcatgaggccatggaagtcagatgcagtcatggaagtcatggaagagagatgcaggctgtagaccaccctaagggttttttagagtcaagaaatttttgttttgttttccttttcatgtacttggtaaatttaaacaggctgacatcctgatttaaaacaaacaaacaaaaaataccagtaaggttttgtttaaagggtttctggctactccttaacaatcaaggttgttttaattataatgaaaagctacttacaaacaccaaactgttgagattttttaaaaattagaaatcattaagattggcaagttcatgggaaaaaagacctactgtgtgaaatttggaacaacttttatggaggataactggccatgagtttcaattgtttgaaaaatgtgctcactctttggttcagaaattctaccaccaagatatagtctggaggtaaaattatatatgcacatagatttgattaaacatgttaatcacagcctgacatgtgactgcaaataaatggtaacagttgtatgtccagtaacggaagtgctgactatcgtatgagatgagatggaataccatgcggccattctacattcttccatgatgcagaagaatattgcaggtcgatgtggtatcaatgaaacaggcacatgtttcagaagaacatcaacaggattacatgatatacattatgtataaattgctgcataaattatgactacctgtgcatgcatctctatatacacacacttatgccacatgtataaatatatatttatgtttttattatatattttatatacattatgtatatatgtatgcatgtgcacacacacacacgttttaaaagtagatgggggccaggcgtagtggctcacgcctgtaatcccaacactttgggaggccgaggcgggcagatcacctaaggtcagaagtttgagaccagcctgaccaacatggcgaaaccccatctctactaaaaatacaaaaattagccaggcatggtggcacacacctgtaaacccaggagaatgccttgaaccaggaggtggaggttgcagtgagccaagatcatgccattgcactccagtctgggcgacagagagagactctgtctcaaaaaaaaaaaaaaaaaagaaaagaaaagaaaattgatgggaatattatataccaaaatgttaacagcaattttctctaaatgatgaatctatgaataatttttatcagctttatttttttttaaagttctgctttactattaaaatctgaaaagaaaaaaagagcactttaagagtgatctcttcattatcttcaatggctctgaaaaacaaaaaacgtggtgggtaagaaagtcagacaacatggctaaatattccccaacaaattcgtaccctttctttccgagatctttcattattttgagtggtgatattgcttcctaagagattatgacacatcttacatgcatgagctgcattcatttcaaacctaagaaaagcagggtacctcagaccacagctaagctggatgtattaagtggcctgggatgtgtaataacatgcagacagatggagctaaagtctttcctgggcagagagctctatatcaacaaacgtcaaaaatgtgatatgggcagtctttgcctgtgtcctgggtcttcggctctattaaaaaaagaaaaaatattttaaatgcatatcattaaaggccacgggcagataatgtgcttccctagaacaccagcccaaggactcatgtgtggctgtcatgaagtcttcaagaaagctccctttctgatagaaatgataacgttttgaaatcaaatcaaacacacacacacacacatgcatacaagatccatgcaaacaacacaagaggcctcggttattatttttgaattaccttgtgtatgagtcagctcctgttcttggttggaagcagaaataactgaacttgtctgactttagcagaaagggcttcactgaaaggttactgaagaaagcacagaatgactgggaagtttttgacaactgcagtgtgcaggaaagagctagctgcctgacagtgccagagtctcacatctcttcaggaaggcctaactgacccttggccagctcctgaaaacttggccctgcaatattccctgcgctgctaattaataaggttgttttgtacacccggggtcctgacacatgctgcccaagcttatctagttggttcgtaccaagtcaatagcatgatttacggtggtcacgtttcctcctggaaataggtgcctgtgtgaccagctcctgataaaagctctagcctctgagacccaagctgccctccctgggcttagacacttggcttacatcactgaagttcattgctggaggagtgagtgtgtcttgcgcaaatccacaggaagactttggaggccactgctgggtctcctctagacactgcctggtgcatttgttttccttgctgatgccactgcgtgttttttcactgtaatgaaccatagtcctgagtctccctgagccctgtgagcccttctagtgagtcacggaacttaagaatggttattggccgggcgcggtggctcacgcctgtaatcccagcactttgggaggccgaggcgagcggatcacgaggtcaggagatcgagacaatcccggctaaaacggtgaaacaccgactctactaaaaatacaaaaaattagccgggcgtagtggcgggcgcctgtagtcccagctacttgggaggctgaggcaggagagtggcgtgaacccgggaggcggagcttgcagtgagccgagatcccgccactgcactccagcctgggcgacagagcaagactccgtctcaaaaaaaaaaaaaaaaagaatggttatgagacaccagaaatagactctaagacagccaggcagaagccaacacccagaacaaaggccaggcacagaaccagtcttttttttttttttttttttttaagacggagtcttgctcagttgcccaggctggagtgcagtggtgcaatctcggctcactgcaagctccccctcccaggttcacgccattctcctgcctcagcctcctgagtagctgggactacaggcgcccgccaccacgctcggctaatttttttgtatttttagtagagacggggtttcaccatgttagccaggatggtctcgatctcctgacctcgtgatccacccgcctcggcctcccgaagtgctgggattacaggcgtgagccaccgcgcccggcccagaatgagtcttgagtaaatgttgctgctgccatcacagaacaccagaggccacaatctaccccctcccagctccttctaggacccgagcaggacactggagatccactggctcccaggtactgtaactgagactagggtttctcaagcttggcgctgtagacatttggagtcagacaattgtttttcgtgggaacattctatgcatcatagtatgcgtaagcagcacccctggtccttgcacactaaatgccagcagctccctcccagtcgttatggttgaaactgtctgctgacattgccatatgacttctggggtcaaacttgtgctcagttgaggagcactgacttagaagaagctaggtcaggtgtccatagagtagctacaagcacatctagaaatagagactctgctgactcagattctgcaacttcttccttcccaccaaaattcctactgcagagcaatgccagacagaggacgggtgttccaacgcgaagcaggcaaaacaccggcacccacccactttgcaacacacttggggcttttgtcaatatggctgcctgggtgaaggtgaagcctcacgaaccataggaattgtcaggtctgctttctaaggagaactttattcactgacattctggctcctgaattaagagctgtgcgggactgattaaaaaggtgtcattgtattaagaaatgaaagcctcgtgtttcaataagcatctctgataagaagaaaattgctagttagtacacatgaaatcaacaggctgcttgatgcctatcgaaatgtgtgctccgttttcagaaaatccaaacgaagaaggaataaatacattttaaaatgttactgggtaaaatccactgatgagctctccgtggtctttgcctttatggaacttccacatgacatcctctaaagggggagggcaggaggggtgcttgttgccgtggcagcaggtgcggtgtggggaatggtctctagcgctgcatggcagcgctgtcctcacagcagctgccaccctgctttcaccctgatggcctgggaggcggagtttcatgagagagaagcatgaatctgcatccagaacatctgggtttattaggcctaggatttttctgcacatttgtgctttgtcaaataatataataagttcctaaaagtcagagggtagatataaattaattgaaacaggagagcacaacccaaaacatgcttttacagagaactctgagaaaaaaaaaaaagtggagaaacaaaagaggctctccaagcttccagactgtgagctagcgcagagacaatgatcagagagattgactgggagaatggagaggtggcagctggtcagtttgctgcatcgccgccccccagtcctcattcctccttcttatagcaatcacagggcacttggctgcagaactcaggcaggagcagcgcctggaggtggaagggacaacatggcagaaactcaagtgtctaccaagacccaggaagaaggggagagactttgcagctcctggcatgacaggcctcgcaatctgtcctgcctctacctcagaattactcgaaataggctgaagcaagcagtatgccacttaaacccaccgggtaaaaggaaagctcaaatataaagataagcaattttaaaaaaaacaaaagcaacaccattaaagtgaggcatacacatttaaaaaaagtagagtaaatagcatctcatgaagtggggttaatataacaaaaggaagtaaactttaagtgaagtatagcattctgagatgaatgtcagaggatccttctcccatgaaactataccagatttattataatatgtgatatttctaaaataagaataaaatatacacatttaataatatttataaaacaattattgttgacttaattggaatatttttgatgattacattattttgaatttaattactaaggaacattcctccagctagacagattcaaaaagattaatatgttggggtaatagtttttcaacaaaatataatttacctattgttacgcagttcatatttctccattttgttcacaagcatgaaataaaatatatctattcaactattctaatataaaattaagttaattcatgaaaaagaaaggaaatgggtccctttacattattcattcttagtgaatccactctggcttgagttgattactgctttaatatctatgtattaaggtactacaaaataatctgttctaggagtttgtttcgccattgcatccacaggcattgtaaatacgccgatcgatactttctagacttaatgaattcatatttttggaaagatagaatttgaattggaaagcttttgaaagagagcccagtcaaaagatttgaacagacacttgaacagagaagattttaagcatgtaaagaaaaaaaaaaaagctcaacatattagtaattaaggtaatatcatttaaaccgtatgagataacactatgaaatctagtagaatggcaagaaaggaggaaaggaagaaaaaaggaaaaagagaaaaagaaggaaaagaaaaagaaagagagagagaaagagagagaaaaaagaaaaagaaagaaagagagagagaaagagagagaaaaaagaaaaagaaagaaagagagaaagagaaaaaagaaagagagagaaagagagagaaaaaagaaaaagaaagaaagagagagagaaagagagagaaaaaagaaaaagaaagaaagagagagagaaagagagagaaaaaagaaaaagaaagaaagagagaaagagagagaaaaaagaaaaagaaagaaagagagagaaagagagagaaaaaagaaaaagaaagaaagagagaaagagagagaaaaaagaaaaagaaagagagagagaaagagagagaaaaaagaaaaagaaagaaagagaaagagagagaaaaaagaaaaagaaagaaagaaagaaagagaaagaaagaaagaaaggagggagggagggagagaagagggagggggaagggagggaaaggaaaggaaaagaaaggaaggaaggaaaaagggaagggaagggagagagagggagggaggggaggaaggcaagcaggcaggcaggcaggcaggcaataccaaataatggtgagaatataatggaaaaaaagaaaagaaaaaagaagattgagtaagggagggaggcaggcaataccaaatgatggtgagaatatgatggaacaactggaactctcatatactgctagtgagaattccaaatagattagctattttggaaaacagtttgacagctttttatagaattaaacacgtatttatcatccaattcagaaacactacactgtgttcatataaaaaatctgtaaatgaacgtttctactggttgtattcatgatgtcccatcactaaaaacaacccaacaacctccctttcagtaggtgagacaataaaccgggttccatttatacaagggaatacgactcagcgtgcactgatgcgtgtgacgacattgatggatctcagatgcattataagtgaaagaagccagactcaaaagtttgcatttctaggattccattgatatgacattctagaaaaagcaaaatatagagacagaaatcacaacagtggttactaaagttgggagaccagggataaaaatgacaaaaaaggggcaccaggaaagtttgggtgtcccacagaaacattatctgattgtagtgtgactctaagcatatgttcaaaagaagaaatacacattaaaaataaattttattacatgtaaattatatctttataactacaaaaaaacaaacaaaaaaactaccgtgggataagtggagcccgagatttgagatgagctcataaagagtgatttggggtgctctcctcataccaggcattctcgtgaactcctctccacattgtgtctttgggtttcatgactactatcacatgaggtgagatttcattctgaggcaaacagcaagaaaacggacattttaggaaagtataaattcccagtgacctgactggagaggcttgaggatcactggttcaaagctccagtgtacaaagcaatgctgactggatgccctttgcagccaggccaggccatggctgctaagcaccctctgacttctgcttggggaccagatgggatggcacccagagaagagtgctgtttgccaaagtcatatagtgctttcaggacatggttccaccagacccaggtgtccccgttcctctcttagggagccacccattcatctatatctcaattttgcaccaaggggagttcgtaaatttatttagaggccatgtacagagatggccccaaatggcaaatccaattgagctgttaagaattgctgtttttgagagtccaatgtacaaagggatggatcaagatgaaaatgtgaactggcactgaatgaggtcatggaaaagaaagaaagaaagagagagagagaagggagggagggaggggggaggggaaggaaaggaaggaagaaaaaagaaaggaaggaaggaaagaaaggagggaggggaaaaaagagagagagagaataaaagataaaattcaaagtaggaaaaccactttttacatcaactaccaccacgatgacaaaatttctagaaaagacaaaagacttttaaatactcagttgatgcattgctattttaggtcatgtttccttttcacttaccagaatattactggaagcccacaattatcacctgcctcctattttcttaccccttgaccttcacctgacccctgaagtcaacgtactttcctgactttaaagacaaaaagaaaaggatttgagtgtccgccccactgttggaggtgtacaaaaaaaggtgtgcttcaatgggaagcgccacaatttctagactctagaggttatcacattctaagttttcattgtctttgagctattttacaaacctatagtctgtaggtaactaatgaacaccataaattccacctgtcataggggtttaattggtttccctccccaccgacaccattcccatggaaaaaccagttttgactccatttgcatattcatttcactattactgacaaataaatgttggttttgatccccatttcaactgtttataatgttttcctagctccctcactgaatgaggtaaataaaatctttaatgcatgttcatttgtacatctgcaggaggtatagcctgcccgaataccagcacgaggggtctagttggaaagctggattggacagctcctctgtgcagcccacacttgaccacagtcagcacttttggcctgagaccaaaagtggagcaaactcagctctgtcttcccagtcgtgctttccactgagctggctccgagtctgcccccaggaaatacctgtttagagttaaaagcacttaacactgatttgtatgtacatgatacaaaaaaaaaaaaaatcagcattaaaggttataatgtgctcattctttgtcatataattggacctaataaacaaacatcacattagttacctagtaaatttcaacttattactaaattagtagctatcctcacatacatcaaatattgtcaacactttcctggaagctgccgctacccacaaattgagccaattaaataattaattgaagtaaaatgactcctgtccagcagaatggatgtgagatgtgtttactcgttcaatcaaatccttccttttccagaatgcatcattttcaaagaaggagatctgaagcggggccctggctgactcattgaagactgcataaaatattttgaagctattcagaaaaaaaaaaacacattaaaaacaactttcatactggaggttaagaggcagaaatctttatagagcaaagttcctttgttttgtatgctatttcctgagtgcagtgaacttattaagcactttgatgtagcaaaaattgtgatgtgtatatgtacaaatgatccaaacacagcaaaaagcagctaaaaaaatcaataaagcagctttttaacaaatgcattccaaactggatcaaagagatagcctggcagctacatgctactgatctaacactcattacattttcatttcaaggaaacatcttttgcaacagaaaggtgaagtctatctgtaatgagcttcttctaaggcaggaggaaagcttcttttcaaataggaactaaataaatatggggcctgtgtgggtctctgcaaacaaatctgtgcagaagggctcacctttgaaagaaaggcctctacaaattcaaagagggagcttttcattgatttttccatcttcctcactgtccttccccagaatagactttcatatgtaaatatgtggtcaagagaaaacacttgcctacggatagtggtgtttttgttttgttttgttctttaagggatagtcactgggaactggatgctgtaaaagcttacccatatctgatttgataatgatattcaccattgattttatagcccaagggaggggcccctttcagaatgtttccaggcacacaagatttttttcagtgagttcactcagaaggttggtttgtctttcagtcttcatatggcgataagtcttgaggatggttttttttgccctgtgttctgatcatatacacccattccaggttatcttacccagggcttcctgcctaacagggacattcttgcctctcacagaatgttgtatcaatcagatttttgtgccgattctcattttgcccctcagcctctacacatctcattttcccattttactaacatgcaaactcatcattgcctgtatcactgggttaaaataaaataaaacataactgactctcaattaccttctggaaatatgacagaaggaggaaatagatgaaaaaagctcagagacagaaagatctttttttaaacttttttttaagaactgcctcatgcaaacatctacctagaataaaatgtcaccagcactgctgtaagatcggattgaaaaaagagtaagactttccatgttttggccaggcccttagaacagaggcagggattaccaaagtaggaaaacagagcagcctcatctccaagtggggtgagaggcacctggacagcctgaccatgtgaatgatgcttgggagcagggtctcctggaatgcagaacattctcccaaagaaaagaaggaaggctggcaggacatgaaagccaatacccagcacttttgagttcctaaataacctaccagaagggctaagaaaattgtgtatagaagtcaggccaaaaaagaaaaaagaaatattagattaggaaagaagaaacctttgtgtgcatacacatccaaaagcacatccacacaaacacacactcatcactccaaccttccaagcacctgcaaattgggaaatatctccaatacattttgaaagaaatgaggtgtaagtaattgaatgataatctaaatagcatattcataccagttattttataacataaagaaaattctttgattatataaagtgagcttttataatctaagagtatatttattatgttagttgctgtgttgacataaataggtattatacaaatatattctcaccataaaaaaggcaaatagtatatacattttgaagttaaataaatgtttagtttaaatcattattatttaggtgtccaaatgtgaaaataatgaacatttatgaacaatttctgaaacaggaatgagtaacctgaaaaaatgagagatgttgatgaagttcaattgatattcaactcaaaacaaaattaatataagagtaagaaaccacagagatatacatggagactaactgtccacattttccaaaagaaaatgaaagatcttggggaataagagaaaaacattatacaaagatgcattataatgtataatacagtaatacttaaattctccagaaaccagctatccggcactttcctctatggaagagtcgctcaacaaaggcccaccatcctgtgtctaggagtctcctttttcactccctgagatgagattctatgtttctcatctctggcttccctcctaacagctctctcagtgccttctccagccttttctggagtgcaagccctcatcctaaacttgctcagttagaatctctctctaccctgcacccaccccaatcacccactcaaggcggatcctgctgcaggagctggaaagcccccaccctgtggccttctcaaggatgtcattacgtctgttcttttatctttcttgtatctgcaccacgacagcttattctctattggatcactgtactcactgggcaaacatgctctactgtatctcatctttacaaaaaacacataaacaaataacaacaacaaaacaaaattccctttagctggcattctcctttactactgctccattttcctctcaattttccccacacaatcttcctcacctcttcctcctctcgggaaatgggaaaccctattcacctatgtctagcaggctctttttgaaattaagtacatgtttattaatagtttaaatctttattatttaggtgtctaaatttgaaaaaatatggactttacacaatttctgatagatgaatgagtaaccagaaaaaaatgagagatgtttatggaattcaacagatacagaacccaaaataaaattaatataagaccgattcctgatttttaggagggaaggcagagttgggaaatgccaaatcgcatcacagggagtggacagaggagtgttgcgcaacccaggaatattcttgattttaccatcttcctgcctcatccctgccctcagcccatgtcaacacacccatcagcaggtcctactcctgctatctgaaaatgtatctcacatctctccacttacctctacttccatttgaggtcaccatcatcccttatgtagacacctgaaataacccccatctgatctctctgcacccatactttcccctctacaacgtactccccatctctagtagcaagtgtgatcttcttcacccacccactgtgtcaaaccctatgttatactccttcttagaactctttggtgactttccattgaacttagaatcaaatcaaaatgctctccattgcctcccagcctctggtgatctgaatcatgtctctagtcaacctcatcttctttttagtttcacttggctccagccatgctgtctttttgcattcctctttgacaccacttatgtggctcgttctttcccattctattgtacatagagagaccttcctgcttccctaatctaaaatagaatataagcttcttaaaggcagagggttcattgctaccaagttttccattgtatttccaaagcatcaatcacatagtggatggtaagtacatatttgctgctaaaatggcgaagaatcaggagaacagaagaaataaaacttctcaatggggtcaaaacaagtagtacaaagcgaatgctataaaacttgaaaacttgattcataagaaagcatcttgagtttatggatcttttctttacgtatcaagaaaacaacaactaaaattaactgggaatctggtttccatatgctcagcctactaggaagggagaaagagctccagctgccccctcaagtaacagattctgactgagagatacaccgactgaggacagaagccatatctacttcatgagctttgtgtccctaacatctagtacactgcctctccataatagacagccacacgttagttgaatgaatggacaaataactctaataacctgtggcaaatagaagtgaatgcaaagaactaggagaggactgaaaaattgataacagatttaagttgggagatcacagtgatagctgagtggaccaaatcttaaaaattatgtagcattagaacttgtggaataggcaagaaaagctgtcaactctatgaaaaccacaagggcaaatccaactccttccacccccactatatgagtaaatatgttgtggaaagccttaacaattctgtgagtcttctctaaaatcacttgggattttaaaagctagtaattttctttaaatatgcaatttaaagactcaattacagcgagtacatgtttggattcttccttttctatatgcagtcaaccatacttaagtcaccttgaaatacaacaaaagcaaaacccttatttctaaggacaatccagtaatagcgatgactttacatatatctataagatgctgtaatttagccaacacttgcacttacttaaactcctttatcattcacagcacatctgttagtagatatactatctccatgattcagacgtgaaagctccgatttggagaagcacggggatttaagcatggttgcacagagaaatcgaaccattatttggattcagatttactaactttaaatcagctgtttcccaccacctaagcatgccataactactctttcccattcttggacagagtttttctgctgtgtttttgtcttctcttctaccctgctgggaagggtagaaggaaacttgaagacccccaaagttgtgtgtccgtgtatgtcaagaatgattcagatggtacatttgaccactttgtataccaccttgttgtgtatttagtgtggctcagtaaatcacacaaccccagcacaatgaaaccacaaataatttgtgtcttttgtctttgtagacagaaaagatcatccataaaatgagcaaatatattggaagcccaaccctcttttctgatccatacttcgatagcttaactgaattcagcagagtagcattattagagaagaaatgaatcctaacagttgggatcatgaaccctggagccaacttgcctttgtgaaagcctggctcccccacttaccagatgagagaactttgacaaatgattgaacctctacaagcctcaactgcacttctacaaattactgtacctctacaggcctcttcttctataaaatggggataacagtagggttgtcatcagaataaactaagttaaaacagaggtcaaaccagctcactgtttgtttttgtaaataaatccgtattggaacacagccaagatcatttgtttatgtattgtctgtggccacttttgcactgcagtggcagagttatgtagtaataacctagatctcatggcccacaaaacctaaaatatctagtgtctgttactctacagaaaaagtttgttgactcttgagttaatagatgaaaaacatttagaatggtccatggtataagcacttgctatctatctatctatctatctatctatctatctatctatctatctatctatctatcttttcttgtgttttttgagacagggtcttgatctgtcacccaggctagagtgcagtggtgcgatctcagctcactgcaacctccgcctcctggggtcaagttatcctctcaactcagcctactgagtagctgcaactacaggcatgcaccaccatgtagctaatttttgtaatttttttggagagatggggtttgacatgttgcccaggttggtatcaaactcctggcctcaagcaatctgccggcctcggcctccctggccactgcacccagccctatatatctatctttttgtgtgtgtatgtgtgtgtagtatgtgtgtgtgtggtgtgtgtgtgtgtgtgtgtgtgtgtgtgtgtgtgtgtgtgtgatattacttactctatggcaagcacttaggatgtttactctacttcttgtcctataaaataatttagtctctactcttatgcagaggcccagagattgagagtcatgggtcaaaccatttgggattggacaagattatccttatacatttcttcgaaccctttaattctagaaaattcaaaaccaaattcaaacagaagtaatcaaatttactttggaagggttttgagtctcataaaaatgtgcaattgtgcatttgtatgtatagcctgtatatccagttaaacgatacccaaactcctcaggggaagattacatatctatcaaccattgaagccagaactggccgtgtcacttgtttttgccaatgaaacaagaggagaagtgaggaaggagttttaagagctagtttgagacttactgtgttctctttttctcagtgctcctgatatccaaaattccccagatgcagcatgctccctcagtgtggaaggtccatgagtaaggaccatgaaagtcacagctgagccaccagggcaaatggagtaagcaagaaattaatcagcctttgttgttcgaaggtgctgaaggttgttagcctaccacaacatagcctattctgattgatacagtgattgttcaatgtctgccctttgtccagagtataaaacttccatgagaaaaggagacaaatcatatttaatattaataatcatattcatatttactattggagacctggcatctactatagaacctgacatatacatacagattaataaaagaagttatctggtagcatgtgaatagttaatagaagaggtaaatgacaatatagacaacatagagatgttacaattactattaagtgctataaacaaagagggtgccctttatgacctagattccctgggaggcaaggagtaaatgctgatggatgtctaccatggagcccaacaggaagaggtgtggtggccaggaaagcagaagtgaaaaggaaagagaagggctgtataaacaattaattaagcaggaaagcacaaagtatgtctaatattagggaacggacacatttgacagaagcagaggcagagagttcatacagaggtgaggtgagaataaaatctacaggaaatgcatgcattgttggataaaacccgaatttgcaaacatttttgttgctttaaatggtgtatagtcaacacttaaaaatggctcaaattgtggattttatgttatgtatattttaccacaacaaaaatctctgtctccagggttcaagagattctcgtgcctcagccttctgagtagctgggattacaggtgcacgtgaccatgcccagctagtttttgtatttttagtaaagacagggtttcaccatgttggccaggctggtcttgaactcctgacctcaagtgattctccctcctcggcctcccagtgtgctgggattacaggcgtgagccactgcgcccagccaaagtaatatattctaaaaaaataaataaataaaagttcagtgttgatccatcacccacctggatttagggcagaaagttactgttcactgagcattcggccttcactgtacttgtcagtgggggatataggaaaagtgcatgtagaccccatcagctttcctggaagcctggacacaaacaaaaacgctggagagagtctcagatgaacacggtagagtgtcacccaaaggtggacagatcattacaatgtaatttgatttttgagggagttgggggaagaaagaatgggctcagaggctatgaaacgaagtccccgcttgaagaattcaggtcaaggggccaaggagagaaagactctgggggttggagcatctgtcatcaatctggataataaaagtattatcattttataaattagataacatccactttctccctgtgcttttcagcagttatggccattaaggacaccatgttatgtagcagaaattgtgtatgccagcaatgaaccttctgtgcttacacattttggccaagtcacttcgtattatcttatacgtggcctctctgcatggctcagtggctcccctcctctgctccaccagcctgcagatcagctctgccacagtgcagctctatctgccccatgtcatttgtcttcttgttccttatttgactcttgccagcaaatctcaccgcttgataattgagccagctactgaactgctctagcagctcagattcctttccctagctgtcaccatcaggtccagtctttcactcccacatcttgcctcattcaaccacttttgttatttctttaaaataaaatgtgtctgaattctgggcatggttttgggtgggattctgggcttgcatgggtgattcaccgttttcctccagctgactcagagcacccctgcaacccaataagacttcccagtattgggtctactcttttgtcctgtccctcaggccccacagtcatggaattggtgagaaggaattaagacactgaaatcagtcatggaaacaatcactctgttcactccagcacatttaggtggtgttccatgtttactggaatgaatctggatgatagaatctcaggactgggagggccaaagaagtcatccattttatctctgtcccaaagtaggaagttatacagcaacacatctgatctctgtggggaacctcactccccatgaggcttcccagtcatatcaggagacatgggcttgtggtgcagaaggaaaaataaagggtgatggcaacagaggccatggctttgacactatcctcgccaccatgggcaagttcttcagactgtctgcatgttggtgctttcctagtaaaatgtgggtacaattctgacaaagtctgcctccctgcgctactgcacaggttctgtgagaaggtgcatttgaacagcacgcgtccacgcagttgaagagggcatccttttacagctctgagtttgcaagggtagtgccctgggcatggggcctccaaagagctatgctggcttccaaggctgctgaccaggtctatgctgaccccagtgctcaggggttcatgagcctgtcagaaataggagggcaaaataataaataaaactacccccaagacaaatccagctattgtagccaactgatagaatctgcctatacctggctttatgaatacttgtcattctgtaaataaaaaaatgaagaggtagagaaagtcgtttacaagaataaaaggaaattgggtggggggagggtgagaggacagttgttttatatatacatatgcatacacaaatgtattaaaagacacactactatcacacatatattggggagttgttctgctcacataataaagagctgttttacacacacactcagtaacgaggtaaaacatataaaggacacgacagttcctgggacacagtatgtgctccatagtaaatgctggttattatcattgttttcagtatatccaacactgagcccaaaataaaataacgtgttttgcttattggaataacaagatcacacgacagcactgaaattgcttagtcggaaaatgcaagaggtctcactcactcttcatccctaggccggtggctttcattccacgttgattgacaagcacctgtgcggtgcttttagaaagaccactacacttaactgtgctgcatccacaggaagcccagcgccactggaatggaaagatggacgtgaccatgtgcgaatcccttcaagaggctgtgggttccctttgcacactatgacaccaccgatactccatcactttaagcaccaacactcaatcatttccttaaggttttcatgggcatcacttttcctctttatttgtcctaagagaatttattctcagagattttgtaaaagagcatggcaggaacttaattatccatttcctggtaattttctacatccgttgttccatattgatttgctatttaaaaccccctttaggttgtttactgatgtcctcccagcctgtggttcttccctatttaatacatcatcaccagcgaacacaaatgctgggtgacagttactttcatcgattccaaccaatgtgatacttgggttttggaagcagagagtggcagtctgaaacgactttttctattgcatctggcacatggtcacgtgaaggaatgcacacaacgtataatcaaatggcggtggtcctgagaggaaggcggtgacttcacaagatctcacagcaagacccagttccacatctctctgcaagagcagggacccacagctcagataaaacaagatggctatactcttcgttcccaatatgtcctagaaattgctgttctcagtaaatagcatcttaataaatcaaataaactattagtaaaacaaaatatgtacaaatttaaaaagaaatatttgggacatcccacattaaagaatgtgttaacttcaatgtattcatttgaagcctgtgtatccacagccacgtacagtacgtgcacatggcgatttttctattttggcaataactgagtgagaagaaaggaggggttagctagacattgagaataagatggctgctcagatgggcctccgtcaggactgtaggctaagaactgtttgatggggatgcatggagtcaaaacgcaaatgcctggagtgaattttgagagcgtgttcaatggtgtaagatgcttggatgtgtgtaacttggaatgaaccatacacagaaaacacaaggttgtcttttcccaaagggaggcagtctcctattagattgggaagcctcccagggaatgatgcgccccagagatcccatgttgttgctgtataaggtggtcttctcccaaagggaggacacaaagggtttactatttcttattctcgacccaggaacatagcctaacaaatagaaagaaagagaaagcctagcagctatttattccttagtgggatatgctcctttatatcccaatataaaggaatctcaaagacacaacatataagtctctttattgaaagacgacttgatgaacggttaatggaggagtaaaagcacaagagttacatttaagaactttcaaaacacagaaagtttgaaaacaataagaggaaagatgtttcaggaatgagattcagaccagctctgtggcttttgttcctcttgttctgtccgtaatttttggtggcagcggttggcagtaggcatagagctggcatcagcctctgtctgcacacagagggactttgtgacggaaccgtgtttccccactcagctcttcactaccaaggcttctaccagcatgcagtggtactacactcccacttgtgcacttacggttctgtttgcctacaacactcttcctccaaagatttatccttttccctcatctcttcacatttctatggggacccacagctcagatgcaacacgatggccatacttttcattcccaatatgccctagaaattcctgttctctgtaatagtatcttaatacatcaaataagctatcagtaaaacaaaatatgtacaaatctaaaaagaaatatttgggacatcccaggttaaagaaatgtgtgaacttcagtgtattcatttgaagcctgtgtatctacaaggttgtcttcagcacaggcacgtggtgatttttccgttttggtaataactgagcgagaagaaagggtgtctttgcacccacgtccacctctcagaaaccttcaccaaccatcctgtttaaagcattaaacagcctcaacctactatcacccttccttgagttatttttctctacaacacttttcatcaaacatagcatgttacatgtttattttagtagttgtctgcctgctcccactggaatataagtttcacaaagataggaattttgtctctctaaaattttctgtagtcttccagcccctggaatagcaccaggtacagatgagttcttagtacttctgtgttaaatgaaagaatgacggcatctgggaacagcctgtagagaggtaggtcaccattcaaggaagaagggacacagagaggggacagacaaggcagaagaaagaagggaaatcccatcgacaggagagaaaggggaaaataaagaagagaaagcgaagacacacagcagacagcctggagggagggatgtcagcaggagggaaaaggacagggcagcagtaccaaatgctggtgtgcgggccagacactggagaccgctggatttcaaaactcagtgcctgctagggaacttcaagaaacacgtgtcagtaaatgatgcagctgcaaattgctaccgaggtaaagaaagatttagaaagtagagttaatgaaaataatctagttaagaaagaaagagagagggaggcaggcagtctggccagccagccttggcagcacaggcctggagagcaagcttgttactttagcagtgtatgccggtgtgtgcgtgggcaggtgtgtgtgcatgtgtgtgcatgtgtgtgtgtctgattcgtgactgtggattgagaatgtgtggacagttatttcaagtacacaagatctgcaccatgttttcttttataagcaaatgggagaaattaacactgaattaaaatgtggtgtgtattttagtttctctctgtatttcaattccaggaaataaattatcacaattttcacaacttcaattcatttagagcctttttagataaaaattttgtaatcgctcagaactgcacttccaagtcaaaagaattaatctaaatatgtgttgctgactcaaatagagaagagtaggaacaaagtaaactcctaaaaatttttcttaaggcattttaaaaaactaaaacaaatgaaaagccctataggacccaaacacgcaggcaaaatgaattctctgaagagaaaaatgcattttgttctaatattctcttaatagatttttttaaaaacgtgataagaagattgaaagaaacctgggtaactcgagatagattatgcaaatgctcatttcattttcctacttctgagtgaggcctgggcacagttttaaagctgcaagaccccagcactcgctatctctgctgcccagctggcgcgcacaaccaaaggattatgcataagatgcacgtggttcacggagccaagacatttatgcggagctcaaaggaatctggcatactgtggttctcgggggcttagaatgaagattttaaaaatacatttccatgattttcaccagcttatctcaaccaagaggttaaatattagagagagagggagagagagagaaagaaagagagggaagaaggaagggggtggttcactgcttctgcagccaggaatggaaataactttgattcttaggttatatttgatcatcaccaagtcctttcctcatctcctctctttccgaaaatgtgagattcgtatcagtgaatcttccataccaaattttactataaccattcctttttccagggtagtccctctaacatagaaaaatatgccttggcatcactcaggctcagaggaaggaaatgaacatactatgctatattttcattgtctccacttctatatctataaattaaatgacataacttgctaggaaaaaaaaaatgccacgctagtctgaggattttggccgggggtctcatgactttttttttttttttttcacaacatctcattcaacaaccactccatagcttgaggatatgctccctcaaaataaacgcacctgtcatcagtgttcccggatcagagacaggcagctaataaaaggttcatcaggaatggctgagaagccagggatccaagcggaatcaagcccagctttgtcatctcagcactatctctgtctgtggtgagttacagttccctgtatagaccaaagacaggaccccaaagagaggtaacccagaaaatctacctttgctagaatgtgaaaatatgaaaaacataaaggttgggtatttttcaaaaatagaaggaggcccttctcattcatatatatatatatatatataaatatataaatatatatataaatatatataaatataaatatatatataaatatatataaatataaatatatatataaatatatataaatataaatatatatatataaatataaatatatatataaatatatataaatataaatatatatatataaatatatataaatataaatatatatataaatatatataaatataaatatatataaaaatatatataaatataaatatatatataaatatatataaatataaatatatatataaatatatataaatataaatatatatataaatatataaatataaatatatatataaatatatacaaatatatataaatatatataaatatataaaaatatataaatatatataaatatataaatatatataaatatatacatatatacatatatataaatatatacatatataaatatatataaatatatacatatataaatatatatataaatatatataaatatatacatatataaatatatataaatatatatctatatatatatatataaatttttttctttttctgttttggagacagagtctcactctgtcagccaggctggagtgcaatggcatgatgttggctcactgcaacctttgtctcccaggttcaagcaattctcctgtctcagcctctcaagtagctgggactacaggtgcgcaccaccacgcctggctaatttttgtagttttacaaaaaaccccgtagagatggggtttcaccatattggtcaggcaggtcttgaactcctgacctcaggtgatccacccacctcgacctcccaaagtgctgggattacaggcatgagccaccatgcccggcccccattttatattgatagaattctcattttagatcctattaaaatgatatcagcattttaggcaaaagtagctatagttctatgagaacatcatagaacttagtctttcttaggtgaatctcagagataaaataacatactggaagaagaaataaaccacagctctatttgtcttaatctttgatttgtaataaacagaaacaatcaagggagattcttttttctgtatttgccctgctgtgtacgtcaggtgttgactacccatgtgtaatcctaaactttcaaatggaatttccctggtaacgagatggtaacataactgctaacagacccctgcatatcagtgaaccatgcataactttaacaaatgcaatgcaaagggtggtggtctgcatggattatttctatcaaaaatgaatttatgcattcaccattagaagcagatgcaagactatagcttaaaagcaaattagaattcaagctggatttgcaaacattccagtttaacatttggatagcaaaggaactcagagtttataaaatttaaatataagatagacagtcacaattctgtgcaagcagtcagggttaattcagatcgtttcctctgctcttgcattccctgatttcaagcacggcgaggctggggctgtaattacggaatgggtagtactcactgttcaccagttgtgtgtaagctttaaactaataactcagcaattacgagaaaaatgagcggtaattacacccattttactcgcggctagacagatgggacattttctcctcgttattggcaaactgtcaccacatttatttcatttttactgtttactatttgttgtgctttgattaagagtaattataggctaggaaaatatgaaaaacatgaatgttgggtatttttaaaaatagaaggaggcccttctccctgttttatattgatagaattctcattttagatcctattaaaatgatatcaacattctcaagatatttccaggcaggcttcagttctgtgacagcttttcagcaggggattcccatgtttgctcattatttgggtcgtcatagacccataaatatcctgcattttttttttttttacagcagcctctgtgtccctcacactcgtccattttggtccattttggtccattttgtgtctgatgataaagcacaggagaaatccacccgtcgctgggatccacaggggagtaacgccaaaacacggcaccgctactgtcttcgcagcttttaggatgaggagcctatttctctcccatcactgtaaaataattttatgtatgttgtccagtagaacaatgatgttgagagttctttctacaatttgcctcagaagctttttagtatgtgacattagttttaagatcatgtgatacttagatactgacaaagtatgagcagtactgataacaccagtgggaaaaatagatttgaatttattttgtgcgctcatgtttgtagaaagtactattaatatttaattgatgtgggctagaaatttgaacgattttgaaagaaatgtgaataacaaatcagtacatatagaatgaacatacaatgagcacaagttttagttaatatttaaaatggtatctattttagagtgagcctccatgtgtaaaataatgtacaatttgtatggttcttcgtgatgctttgtgtatgtgtatgtgtgtgcatgtgtgtgtgtgtgtgtgtgtcatgattagctaggctgtggttccaaattctaaacccttaaagttacagccccaggagaaataaaagccatcacaattcacaactggcctgcattgaagcatgattttgcaaacaaaaatgctttttccctccataaaagtcatacttgaaaatatctgagaagttatttttggcatcagtttttcttaatgggaggagaaaaaaacccatgccttgttctacacgggctccatatcgattcatggaagtgccatgtgttaagcaccgacttgctaatagtgctgcctgtgtggtgatctgctgagctagcgccatgcacagaattgattagttcccttaatgagctttagattgtgcttctaccagaataaggacgcaaagcaggggaaagtgtgcatctggagaaaacccacctcaaagcagctgcagagaggaaaatcaagagaagtggcagagaggaaaatcaagagaagtggcagaaaactatgggaaggtgggacttgaggggagacctggagacaaggccaccttttctttttcagaagatgctgcagcttgctccatccctgactttctccccagcggagggagaacagggcagggtgatgtgcaaacctcagtccccagcaatgaccatgtgcagcatggaaaactggggtcccctcttgtctctgcccttaccatgtgggtaaccctaacacccctccctgatccgcagcttcctgtaaacgaggggaagagacggaggatgcagccatctgtgtcttcatttgtgtgcaactgcattatgaaattttaactaaaaatgttccagagaaagcaaacagtgtaaagctattaaggaaggcggtttagctaatggataaccgatgactgatgtgtgtataagtgagagatggggatggagattctgggatgctggcggaggctctgggagcgcaggtaaacaggcccaagagatgtggagagcagaggttgtcacagacacatgccatctgcatagggctcaatctgccgttagtaatttggataagtatccaaagtttacagagaaaggaagaaggcagaaaaggaactacagaatcaaacagctcccctttcctctctgccacactcacaccccacacacacaaaaacaccacacgcacacacacaccaggggacaatgagatgtcagataagcctcagaacttctacggtgttttacacagtacgtgaaagcaatttaggaaattattcctactttcggaaagaaatataaacagacaacattatctagtctattgtgttcatgttgaaagagaacaactgcataagagccctactgtttgtgtaaaaagaaactgtcttcatgtaaaataaccaaacctagtaatacataggagaacgatgctgcatggaattttacatatgtaactcagcgtttattttgcctcttgcctttagtaaatatgcaagggtttttctaatgagataaacagagcgcatggcagtgtggataagatgcacagagcaagctgctctagaatgttggtggccccatgggtgtggtctgggtggtggacgtttaaatctacctcacggaagcagctagatgagtgttatacaaggaaacggggcgagagaaaacagacatgagctggtttccactaattgtaggaaaaggtatcttgattaagtattcaggatgctttctctttctctagaagctcaaaagaagccttttgtttcctgtagcaatgcccatttgccagatcacatttaagtcaagcagacggttatttgagtgaaaacaaaccaatttgcttttgctggttccagttctttcttttggtcacaggctttcaaaagaagctttcttttctccttctcttaaatatgtaacacaagagattcaacatgattgaaaatatctagaagagaagttctagaatatcctaatcttaaggcttggattttcagataagaatttatttgactcctatttggtggatttatttactctgacatggagagccttactacacactgataaaagccaagttaatatgtatttcaaagtttacactcatcatgcctgtaatcccagcactacggggaggccgaggcgggtggatcacgaggtcaggagttcgagaccaccctggccaacatggtgaaaccccgtctctactaaaaatacaaaaattagctgggcatggtggccagtgcctgtaatcccagctactcggtagaccgaggcaggagaattgtttgaacccgggaggcagaggttccagtgagctgagattgcgccattgcactctgcctgggtgacagagactctgtctcaaaaaaaaaaaaaaaaacaaagattatattcatgtattcctgttgtggattgggatgggaaaatcaaggctcagagagggtaaatatttgtccagggtgatacatcttgtactggcacagctgggccctggctgttggactccacagccctgaaggaacacagagatgaagacttcaatactggtgttcctcatgatgcaggcttccctggtgaagaggggcaggtgctagtctaaagaatgaagaaacactggaggcggagagcacagcagggtgacatggctggaacagaggcacgataagtatgtatccagcacaagcaagagggagcagctgatctaggtcatagttaaaagcacccattaggagtactgagaaattacaccggaaagagccatggtttagaactagaatcacctggagagcttccaaaaagagaaatttttctgcccccagttacaggagtttttggttccagaggtgaggaatgaagtccagggatctgcctcttcacaagctctcctgtaattctattttcatttttttaaaaatgattttgagacaaggtcttgctctttcatccaggcttgagtgcagtggtgtgatttcaactcactgcaaccttcacctcccaggctcaagccatcctcccaccctagccacccaaagtagctgggaccacaggtgcttgccaccatgcccagctaatttttattttatttttttagtagagttgggggttctgccatgttgcccaggctggtcttgaactcctgagttcaagcaattggctcaccttggcctctcaaagattacagcctcctgtgattctgatgtgtgatgagaatgagaatcaccagggcagagggcctcccaggagacccagtgatgggctctgtatttgctttgataagagcatagagcctggactcagggctctgggatacataggctggggctgctgtgtgtttcaggctcctggcacctgctgcagtctctggagtgaactaaaactgttttctattagagggatgagtggcggggtgggtagatgaagagacactagagattaatatgataaaattccagagtgcagctcagatatgtaggaataagatctgtctgatggctactgcctgtaaatacacaatgtttttcctactgtcttgaactgagtaagacagattgatatctcatctctaagtcacatttgggtggccttcaggaaggggcctgacttcttcttgttttattttctctagcttggagaaacaacatattttacaagtgagcaacctgtttgagaacagaaattttgcaaacatcagagggtcatggtgaaattattgtagaaaactttggtttaaattcagtttcgcgagctgctcaggaggacttcagagccttaactgtgcactgagaagctctcaggggagaaactacctccacaggtcacccaccaatttcagagtggactgcaaagctctggcttgagatggcagaggttcaactaatttgggatgccggccaagagtggactcttttgctttgctgttggctgaatggtgtctcaccaacaaaattcatatattgaagccctcagtcccagtagaatcagatttgtagacagagtcttcaagttagaatgaggctgttaaagtgagccctaatccaatgactggtgtcctcataagaaggttggccacacacagagataccagggatgtgtgcacagaggaaacaccatgtgagcacacaatgagtatgcagctacctgcaagccaaggagaggccaaacttgccaacacttagtcttggacttccagcctccagaatgtgtgaaaatacatttatgttgtttttgttacccagtctgtggattttgttacggcagcctgaacagactaatccatgcttcattccatccacatttgttcaattgagaccagcaggctcaccatgcataaaaaccatggcagatcttgttaaactcccaacttcccaagccccagcccagacattctaattcagttggtccaagactgagattcagaatgtgggtgacttcagaactccgcctagagaaacagatttcacagcttggcagagtgagcaaagccagcacacagcaggtgcttaataaatgctttctgaatggatgggttaatggatgaacacgctctttcaaataaaagagtacaaagccaaactcagataactttatgacatttctcacttcagcaagcagtgtttggtgagtcaagtggtttatctgtagttgggaccctcatcagagtgagtgaaaatagaaaatggatagctaaccaatggtgaggcaggagaatagggtttagggtaaccaagggttaaggcataagcaagaaaacagcaggttcggccagttctaggaaagattagcacacaggccatgccctcactcctgtgatggcaaaacagtagtttccacctcagcctctggtccactgtgggccaagtcttcacttcagcctctgattggtggtgggccaatctttcatagggtgtgactaactggaggcctcgaaagggcacctaggggtgttaccaaattcttttagcttaatagaaaccctaaagaacattgcattcggggctcttgagctgcttgcttgagcctgctcccactctgtagagtgtactttcacttcagtaaagctggacttttgttacttcgttcattgcttcattccttgttgcattttttgtggattttgtttagttctttgctcaatgcaccaagaacctggacaactcacagtcaaaacgttccatccctaaaatctgaggagatatatagtcattcttctttttaaaacagtttcaaaatacaactgccaaattttaaaaattgttttcaagttactaaagccaagcactcatacccttctaccaaattttgcaagtaaagattcaagaaaaaaacacttcattttattccagcttcaggttttggccacagaagcatacacataccgggggctgccaatctaggacactttcctagcacagcctagaaagagcatgatgggctcttttgagaataattaacgtactctcttcttgcatcctttctccctaatatttcctttcccttccttctgtggtggttgtttgatgtcctgaaagccacagcaattaaagaaaatgttcttgagcatagaaataacaatcagccctgtttcttacagttttgatgattgagtatgctacacaggcatccgaaaccacagagatgcaataactgaatgtaaagtatccgataaagagcagtataaatcatgaaccaagagtaaaaatgttttattagagatgatgatacataaagatgaaattcagctggactgtagaaggctgttaattgaattagggtaaaatagtgaaaattggaactgatccatatttgtggaatcatgtgatgctttaattcagttttttttttagtaggcatccactatttagtaaagacttataactataagtagtatgagaagaataggtaggacgattcctaaatctcatagcaatcaggcaggcatacacggtgcccctcttcatgttttatgttagaaatgcacaatccaattctctatctgaggtaaatactcctgtaattcacaaaacactgtgatgtgttttgatgatattaggtcatgggtctaaaaaatcaagtggttattatacaattattttaccatattcacttctaaattcatttcaatttagaaaaatggaaaaattgagcaaaaagtattttgttgtgtccagggaatattccaaaacaataaattatttaaactgtcttgggacatcaaaaatatttcctctataaaatacaatgggtgcagagtgaaaaacaatacaagtattagaaccttagagcctttagcctataaaattaactgcactaaatgaaaagataccgttcttggaggcggtggaggagataaagtaccaccatgaagtttgagccgatgaagggagcaggctgtgaaactaggattgaaaagaaagacacagggtggaacataaggcctagaaattaatcctgaaaatcactaaaagaagtggctcctggctgcaatcctagcactttgggaggccaaggcaggtggatcatgagatcaagagatcgagaccatcctggccaacatggtgaaaccctgtctttactaaaaatacaaaaattagctgggtgtggtggcatgcacctgtagtctcaactacttgggaggctgaggcaggaggcttgaccccaggaggtggaggttgcagtgagctgagagcttgccattgcactccagcctgggcaacagagtgagagactctgtcaaaaaaaaaaaaaaaaaaggggggctgttcacctgataccatgagcactgatttcttgttagcaaagagaactcacgtggcattgactgatctggagtccatcgtgttgcccaccaaacttcctacaaacttagtttctgttctctagacatatcctagcttttcttccttggatgaaatatttagagatgacagaaataatgacttccaacatgaagcatgtaaaagcgaagagtggctggcagaaaggattgcaggagaaaatggaacacaaaattaacatattaagtagaaagctggtgtgcagttgaatttcagtgaggctgactggccttgctcagctgccagggaacactctcgactcttgtttccaatctcttccaggccctccaggggccctggaccatctcttgggtcccatcacagctgagagcctccatgccctgcatgcatgaatgcatccacttgcacacacagctcgggaccagtctccaagggtttctgccaatattctcttctaaagtttcgctttgctctctgccatcactctatactttcttgccaagaatttataacatcataaagacacaaagttgttcaaattttgctctgggattttgaaggaggaaaaattcaagccacaaatatgcatggggctatgcaaatttatcactgtgagaacaagtttttcagtcctattatcatcactttattggtggccgaattggaggagttgttaaagttcagaagaccagcattcaccacacgctgttattaggatgtctacactaatcatagcttacaaaggccaatcgatttgctctgaaattataacagcaacaatctttgccttagttcctgtgtgggtgagcactgtttgtatatttatatccttatttctggaacattaaaaactcttctgtaatatatttttccatcagatatagttgagaaaataattataaatagcccattaaatgttatgaaacaataaaaaatctgattaaacatcaatcccagactaagaatataatgtaagatttgatgaattatggctaattttatgccagtttttatggttattaaataagtttaatggaccactcgaaattccattacataaatcatagtccaaagtcaggttctcttgtctaaaatagcaaaatttctagtgataggacaaaaatttaatagtgctagcacagttataagacaaaatctttggtgtagttaggataaaaactatatattatttgagaaattatgtccattcaaaatattccttctagaactacataccttcaaacctcatcagataatagtagctaatagctatttttcatttcataatgcagaaaccctaggacctttcaacattaatacaaatgtggctgctttatataatgcctcacatctgcatgaaaaataagacacccaacagcatccagctgactctaaatgtccagatgctgggaatgattcacccatgtgtcttccacattgaatgtgccaaacagtgacgctgagtgggcaatgatgtgctgcatagggggagggagagatactgacatttgttagggaaataaaatgaattaacttggtgcatgcaacagcacatgcaccgagtagcaagaaaacaaataaatagagaaagaaagcagttgtagttcacatacttgcaaaatttggaaaagtaaaataaaagactcagtaactgaaaagattcaataactgctgtgctgcatgtatatctggggtgatactaaaataattcaacaacctgcacaaatacataaattagtaattaaaaactttcctctaatttcatacatatccctgtacacacacacacacacacacacacacacacactcacacactgctcagcaagtttctgaagctatagcattgtttacccaactgtcctgacacttctgattttaggaattgctagggtgatctctcgtttgggcagatgtcccaagctgacgtccgtggctgagctgttgatagtggcaggagacagacaaatccctaggcagacagtggtgggtccccattgaaacccaaccttcaagccgaagacagtttaaagcctagctataagtcctgggtacatccacagactggattgagaacctgtctttccattttggtgcacttttctctgattgatccccacccttcatctattttacatatacctatcctttcctaattagttttctacactgtcgtgcctttgagtggtgtcttcattttaaccttttttgcacactcataaaccaatcagcacacactctccattttgagtccataaaaagctccagacctagccacactgggagataaacaacccaactgaggggttgggggaccacccactgtatcccctctccactgatagctgttccatcactcaatacaattcttctctgcccatcctcacccttggaattgtcagtgtatcctcattcttcttggacacgggacaggagctcgggaactgccaaacatgggtacaagctataggacagcaagctcagcgggtgggggtgcctccaatggcaggcccggggctgagcaaggcccaggcagggggatatcgccagccatggaggtctcttgttggcaaagtggctgagaaaaattctgcatcactgtgatttagcctcacacactttattgacctcccattaagctaatagtcatcaggccagtgcactacatctggttacaaaagaaggtgtctgggctgggcatcacccagaagccagcacttttcagctagcttgaacttaaaagaccattgtcttggtcccaaccccaattcctcaaggttagcctcagcccccaccctgttgggttgtccctgccacctctggcccactccagagcagcaggaggcattgcacacatcccacctggaacctccacctctgtccacctccaagacagccccactcccaagaccacaccaccaccacagcctccatgggccaacgtcattagataatgcgtggtctcaagtaaactatttctgattaccaactactacagaagaatttaaaatatatatactttagcaacacattatgccacattgttttatgctggctggatacctattctggatacgcctctttatgtgctctgacaaagaaatcccaatgcaatgccctggcaatgagaacagtgacacacaaacaataatatgcaggggtggaaaaaaacatgccaaggtagttcacattaggggaggtctcagaagcgctttgagaggtgagtgtgccacagtgaggtcacaaaatagagatgttgtgcaggaaaggttcagttgagcccagctatgccagcaagcccagggcactgcaggccaggtagttgtctctctggattggatggcaccagctcctcttttcactatattttgtctcacctattctgtcagcagtgccttctgcaaggaaacttggagagagagagagacagagtagagtttgctccaggtacagacctggagattgcagaaggctggtggccttgagtctcacttccagggtgctccacactctctgtgagatgagcagcacagaggaggtcataaggctgtgaccgacaacaaagcttattgcaggggtgaaggagcaggggagaagtgagcaatcacttgcaattttaccaggtgctataaaatcactgacggggactttttttttctttttttaattgaactgcttcccaaggtcaaatgcccaaaacaaaaacctcttcatctggacaaggctttatttcatccaagcatctctaagcatttattccctatctgtcacattttgcatgatgtagaggcaacatttccacttatcattaactaagtggttagacaaggtagttatcaatttcacaagggtggaggtatttaggcaattttcatcaatgacattgtgatgggttaattttatgtgtcaacttgactgggttaagagatgcccagataactggttaaacattatttctgggtgtgtctgtgaaagtgttttcagaagagattaacatttgaatcagtgaactgagtaaagaagattgtcttcagccacgtgggctggcgtcgtccagttctttcagagcccggatagaacagaaaggcagaagaaggaggagtttttccactctcttttcttgagctgggacatctgtcttcattaataaagaagtggggaggctgggcactgtggctcacgcctgtaatcccagcactttgggaggccaaggcgggcggatcatgaggtcagtagttcaagaccagcctggccaatatgatgaaaccccatctctactaaaatacaaaaaattagccaggcgtggtggtgtgcgcctttagtcccagctactcaggaggctgaggcagaagaattggttgaacctgggaggcggaggttgcagagagctgagatcgcaccactgcactcaagcctgggcgacagagcaagactccatcataaacaaataaagaagaggggaaaggtggagcctggagagtgggtcaggcaggagcttggtttaggagttttcccagttctaggggagggttcctaaaggttgtccagctgtccagttcaaaatctggagtataacccatgatccgaggaaaagttgaggtctggcctgaaacactatggctaggattctggggcagctttgtgggtgcacagctgaagatttgcagctcaggtcattgcctcatgagctccaagcacacagaccaactccaggccctgtctcctggggtggagaagcatctaacacatggacggccttggctagatttgggttttgaatcacaatgtttaacaccgcaaggcttgagggtcttcaggcaaattactgagcacaactatgaaggcagccactaatagcagcaaaagtgtattcaatatttatatttcttatgagccatctacatggttcaaaagttagcacattcttccttaggctcctgcaggctttgacatacctttatgaactgctccaaggattgggaagtcttcattctcatttgcaaaccgtatatattctgaatacctgctcatatcccatctcgattatctcatcaataatttccatccctctgatttacacctgtaaaagcaactcacttgcttttcccaacctaaagagtgctgtggagtccctggagtagagctactgcaatttcgtcactctctgacctgttggaaactcagtttcaccgcagctttacaaggctgcagagtcttatatcttacatgcatattatagccaacactgttgactgattgctcaagaaatatcttggttttgttctgatggatatatactcagttttagggaatacattatgtttgctttaagtcaaatacaccaaaatcagtttcttctgccaggaattagtctaagtgggacccaacttcaatgagataaagacattttttaaaatctgttggtgacttctgggaaaggatttcctccttaataagggacaggcacaaaagaggtcagcccccccacctttttctctgctggccccacctgctgacctcagcactgttctctagggccatacttccccatttagttggtggcattcttttctcaggggaaaaggtaaaagattataaaggagtgagaaagtcaagttacttttagctggtgagaacacatggacacatggaggggaacaacacacactggggcctgttgaagggtgggggtggagggaaggagaggatcaggaagaatagctgatggatgtggggcttaatacctgggtcacggaatgatctgtgcggcaaaccaccgtggtacctgtttacctatgtaacaaacctgcacatcctgcacatgtgcccctgaagttaaaattaaggttggaaatttgaaaacaacaacaacaacaaaaaaaaaaaaaaacaacttctagctataagaatcctgctttgagcttcaaaagcctaatctctgtgtcatgtcatttagttgatgacatgaacaacagatgccaaaagctatgtgatcagccagaaccatttttttccacccagactgaataacgagcccatggctaacagcagagaagccctgagtcaaggacctatccacaggaggcacatccaatgggaggagacacagtggaaaccacacatggctttgggcttagctgagagcccagggaatctaggcctgtgtgcagtaaagggttaatcccacaggcttagggggtccaaatcccacacattctaaagaaagatcttgcccttgactgactcctaggaggtaacctctaagctgttgcaatttccagcctgataaaagtgtcattacagacctgaggcttggggccaggcaagattgtttatgccaacaattggattatgacgagtgtctgtttttattcttctgggaccctgggccacgctgtgtcagttgaacctctggaggaggggttggagactcaagtgttaaggtaagtcatctgagcactctatgtgactaacccctaatgaaaaccctggacaccaaggcttgtatgagctccctggttgatgatactctgtatgtgttgtcacaacttcttactggaagagttaagccctgtccctataggtctccgggaaagacaactggaagcctgtgcctggtctttcctggactccttcctatgcactttttcctttgctgattttaatctgtatcctttcactgtttcataaactataaccttaacaacaatagcttttcagagttctgtgagtctctccagcaaatcatcaacccaaggggtggtctcaggaaactccaacacagtccaacatttccacatgggttcctgttaacgacacggtcttggagcagtagaaaaaagatggctgctttgatgtgcccaggtggatggtcctacaacagcctaagagagttcctccacctctggagagggtggtccacagccaggcattttcagggtgtctcacaaggccatagatgttgttgaaagagccttttgtggagaggctttatattaatagttaaggacacaagaggccagaggcaatctgactcaatgatggaaacttggtagctgcagatgccggccgtgaattggtatcagtgatggaaagaaggccacaccctctctacttggtctgctgagatcctttagccccaggttagactcctaaacacagaggaaagcacccagacacagagtggagaagaccccgcgttgactgtgatcatcgtgaattaaatgaaattaagattctaccacctggcatcatgcagtatatgttacaaattaagttgaactatacaaaaatacaacttcaattctaaccatgccgtctttgtggattaaaactcatacctggccaggcgcagtggctcacgcctgtaatcccagcactttgggaggccaaggcaggcagatcatgaggtcaggagttcaagaccagcctgggcaacatggtgaaaccccatctctactaaaactataaaaactagccaggcattgtggcgggcacctgtaatcccagctactcgggaggctaagggaggagaattgcttgaacccaggaggcggaggttgcagtgagccgagaccacactattgcactccagcctgggtgacagattgagattccatctcaaaaagaaaaagaaaaaagaaaaaaagaaaaacctcacacccattacatacatgaaaaactgttagctttttaacccaatcaccaatacgatattactgtctggtaaaaatatttttgttttcctttaaaaatcatattggctatcagggaaatggacccaaatatgcagatggaagttgtttatcaagagcatagaaatggagctctaggttgagtcctagaagcatgctctctgctttctggtgctagtacaaaatcaatagcagtactttctcagcacctctttgatgtcagcacatggcacatgtgaagcaagaggctgttcgattttgattgttcactgcactaaatttttacagctgcggtaacaaatcactgcaaacctggtggcacaaaataacacaaatttgttacctcatgctttagagatcaaaatcctaaatggatctcactggactaaaatcaaggtgttggcaggactgtgctccttctgaaggctcgaggagaaagtgtgttttgtgttttccagctcttagaggccatccctgtttcttggttcatggctgcttcctccatcctcaaagtcagcagtgcctggcggagttttcctcacatctcatcatgctgaacttgactctcctgactctgactttcacttataatgacccttgaacaacaccgggcccatccaggtgattcatggtaatcacatctccagattcttaatcacatctgcaaaatcctttttgccatgtaaggtgaaatattcaccttccagaaattaggacacgcacatctttaggggccattactctgcctgccacacttactaagtaccagattttccaccaggggttaaggataccccctcagctgtggagatactctcagtctagacagggagatacgtctggaaatgcgtatttgtactaggtaatcactagctagcttagggagattccgaagcagccagagaaggagagagaaaatggagcctgctttcttgcagtgcacagtccacagcgtgccacactcatgcacccatcttgacagcaactagacatattaggattctgactctcttctctaccctgcttaaggaacctaaaatatcatgcttgtcttagtccacatgtgctgctataacaaaacacaagagaccaggtcatttagaaataacataaaattatttctctcagttctaaaggctgggaagtccaacatcaaggcacagacagatttggtgtctaggcaaggcttcctctctgcttctaaaatgtcaccctatagctgcacctttacatgggagaagggcaaaaggtgctattgtgctcccttcaatctgtctctcttttttttttttttgagacagggtctcactctgtcacccaggctggagcacagtggcacaatcacggctcattacagccttgacctcctgggatcaagccatcctaccacctcagcctcccaagtggctaggactacaggtgtgcaccaccatgtctggctaatttttttctttttttttaatttttgtagagacaggattttgccatgttgccaatactggtcatgaactcctggatgcaagtgatcctcctgctttgactttccaaagtgctatgattacaggcatgagccactattcaacctcttttttaagaccactaatccacctggcatggtaggtcatgcctataatcctagcactttgggaggccaaggtgaggggatcgcttgagtccaggagctccaggccagcgtggcagcatagcaagatcccatctctacgaaaaatacaaaaattagccaggtgtggtggtgcacacctgcagtcacagctacctgggaggctgaggctggaggattgcttagcccaggaggtggaggttgcagtgagccatgattgcaccactgcactccagcttgggtgacagagtgagacactgtctcaaaacaaaacaaaaataaagcactcatctcatccatggaagcagagtgctcatgatgtaatcatttccttagtggccccactgctcagtcctatcacattgggttttaggttccaccatatgaattttggggggacacatacattcaaaccagagcaactcttatttcattttgttctttctacccccttttgaaggctacattcaacctttcttaacgtttccattttattttcacacgcaaatgctgatgatctttagtttcctcaccagccccttcaaaatcctaatgtgaaaatgttcatcgctttttgcaaaccacacagccaagccctgttgtgcatgagtgaaagctgttgttgcttgcttcattaatagccacactgtcaaacaagctgtgtgtgttatttcttcactccatcctcaagttgacaagaaaaaagcttaaatgcactagaagatgcttcaatagaaaaaaaaaaaaaagttctgtctgcacaagtccggtatgttctcctctcttaaaagagcaagatggatcatttttgtgccttctccatcacgcttctgtgtcaccgttgcagaagcttccaccttaagacagtgaattgcaataataaaatgtctcttcctcgctgtctttgatggtggcaatgtaaaggctggagtttaattacatacaacatatggacaaaaattgtcatgcctactcatttcaggccaatggcgaggaaagcaagaaatagaaatcaagagaatcagctcagtttaagtaagagcatgatgctggagtgtatcttatcttatctcattttaaactaaaggagatcaaagttgagaatgttttcttttcttcactggacaaaaaatatgaaatgctaactgtgcatgaagcattgttccaccttaaccctttaatgcaagtatgggacttgaaccatagtatgtctatcaaaaatattttttaaaaatcaaaatctgtgctcaataaagatttttaaacttgttaaagtatttcagattccccattatagaaagttttgcatgtttgaaaggatgagccactgggcataagagtgagttgatgggtgtgatatttacactctctcctaggtggatatctttctggaccctaatggggtaggtaaggttgccttacatgaccttgtgtgtgttgaagcctagagaggcatgaacagtgtatattcatgggcaggcatactctgcctaatcttctatccccagaggttacttttgagctgacacaaggaatatatcaataattagcccttaagatgcaattctctgttggtctaattactcaggccattttcacaggcaataaaagcaaataaaccagggtacgactccttttaaaatgtaaaaggagtaaaaagcaacattagtgggctagttcaagtgcctttcaaactgcaagaaaaagaaaaagtgaaatggaccaattccagggctttattttcagctgagaacaggataccagagggctgcacagacacaggcgcagctacaccctttggtgacttaccctaaagcaatgtgaccactattttctggaaataaaattgacaggcagaaagaaatcttccacaacgcggcaatctgatcagggagtaccccgcaggagtacccatgctgaaatgatttctaaagtactggtggtacaaagtgatacatttctatttgttttgtgtatatacaagagaatttctggaaggttggataccgatgaataactattagtacctgagggtgggggaggcataccagggaatggagagtaagggactggagtgagactagaattttttctgtatgctttttgagttttgaattataaatgataacctgtttacaaaagtaaataaaataagaatgagccaaccagcaatctccaattcagaaatgctactttgtggaaagaaattggccaggtaaagtttcccttggatatcttttaagtgatattgaggtattaatagagctgagaattaacatttgtattgcagacacaggagtccaggaaaggtcccacagagaaccagggttccaagggatctcctgtcataagctgtcacaaagagattttaagatgaagcagcgccattttagttagaggctggctcattctgagattctgcagagacaaagaaaccaaacacagccaaagaaaacatatcaaaggcaattgcacaaatgtcacttcctgcctggtttacaaaattatcatttaatttctgaacctcagtgggtctgtgaagacactgaccttctagctttttgtcaagccctctggacaaatgtgcctctcaggctgcttctgtcatggcttaaaaattagctaataagtggtttgcacttcataagagtaaacaccatgttgaaactgagccaaactgacactctaataggtcacagtgagctgagaagaaatttcattgcaaatcctcaccatggggcgtcctgggaattctacaagaatcttcatattcatgaagcttaattatagcaaaattgccaatctgtaaaatatggctgcatttgcatacgacttacaagtctgaaacatgaacaagaagactacggtccccttgggatgcccacagtatgtgtagagaaacacaagtgaaagaaaattgatggggggagtgggggtaggaagaaaaataaaaacagatcaagaggtactttatttacctagaaaaatgaaaatgccaatcacagaaaggctcttattatgtacttgtaatcaaccataatattcaaattgctgaataaagaatcaaataaaatcataaatttaagacattagtcttaaaaatattactcattttagttcctgagatgaatggaaagttgcaaaggctgtgtgcacacctcatctgttctgataatcgggcaaatgaggcttcgtcttcaagcccctgcggtaatcaacttgagctcttaagtgcttctttggaagaggggaggcatcttgggataccaggattgcagggctcagcaacatacagacggacaaccatcagtaacgctgcccccacagatgtcaccaatgtgcctccaagggtcaaaaaaaatagtcgtgtttctaactatttgataaaaatggaggcaattaaactctgggaaggctatgatttcttagcaaaataaaaccttggccccatgcattcttcccttcctcctatagaaggattgtctggtgtactcctgttcacagcaaatgcagaatcccacactttaaaacatcctctgttcacacctgtttggtgatcagatgagtatctatctatctatctatctatctatctatctatctatcatctctctcatctctctatcactctagttatctatcatctctctcatatctattctgttttctgtttattatctatctactatccatctatctactatttatctattatctatctatctatcatctgtgttctatcagttatctgtccatctatgtatatgcctatctatttatctatgtatctatctttcatctatctgcctttctaccatctaattttcttctgcatatctaccaattatctatctatctatgtatatgcctatctatcgtctatctgcctatctgtctatctattatctatctatgtatctatcgatcgatccatccatccaccccattaggctgtacctgatgggggcagcatcatgttcctcacatggtcaagcatggctgtgtgccaggggccttcaagcaacatttaaagctaaagccaacgatagaaaccataattaataatattttcagacaggttgccaaataacatacatgtaagcgaagaccagatgcatttcaaaaatgttcaagaaattgaatgtgaataaattcattgcttaaaagagaatagcaaatggtgcatgctgtgtgatatggtaacgacaacagcaatactagcagtggtcatctatcaagtgctagttatatgctaaagactgtgttaaatgttttgacatccatcaccttactgcatcttcccaaaaccacaggaggtagatatgattatctcaggaaactgaaactcctgaagttacatagaaaaatggccacacagttaatgagcagcagaaagataatttggccacagatatgcttaacttgaaaatctgagtccttaaagatcgtatactgtgccctctcttcaaatcctaaagaaatgacaagagaaagaaaggaaggaaggaaagcaggaaagaagaaatcaaaggaggagggagagaggtagggagggataggagtcaacattgaaaaacaagggataattctaacaactggccagaagttatagaaatttatattgtaacaacaacaataacacccatctacaatcccttatctgcaatcccacaatccaaaaatacctcaaaaatgaaaaagtattttcatgattcacctgctgccaaaacatggcccaaatggacgtgaggttctatttgagccttgttcattacacacagaataaaaattccacagttctgctgaagaaatcttgaagcattactgccccacattccaccgtgagggtgtagaaaacatgcagagtatggtaacatttacttttagatagctatctaaaatgtgagaaattctgaaacacatacagcccctgaggcttgcctaagctgagagcatgtctgctgacctaagaatccctctgccattatatgtccttgacagtcaagacaataagacaacaacctgtggtcaaaatcaaccgacaataacagaaatttagtgaaaaaagaaacatacatctcaataactgctgaagaaaagcagcctcctctattgcaaggagaactcatggcaatgttatcctattaagatctgacatcaccttctctcccttccaggctaatttcttaactcagtttagtttgagcccaagcaagggcctgttttggactctgattacatttgaacaccccaggctcactcacccttggcctggaggcttccggaaatagagcattttgttacatagtttccacagaaaagtagggagagtttgattgaaatgatttataggaaatctaagaaaaatcttagcatgcacgatatcatttatatgcatttgaaaaatacactgtgttagtttctatggtttacagattcacaaatacgttgcagaggtttcaagatgtgtatagaaaatgtgagtgggacctcaattctatctaacactcgtattcataaaaaaaggaatgaatgaaatgtggcaaagcataaacatctgactctatgttgggcttaagtacctggtttttgttttctttcgtgctttttgtttttgtgactctctgtccttttctgtgtatttaaaatacaattattcgacaacaaaaataaccctcacaaaatatctgctctgtaccaggcacaagaatgacagtgaggataagagagacaacatccctatttgaaaggttttataattaaaattaaaaatgtatgttaatttattgtgtcttcttgggattagaaaacaaacagaatttattagcattgtgttgatttgcttcttttagtggagtttagattgataaaatcattaacactaacagattgccctaacaaaatggacatatttccaaattctagaaagacttcaggcagggagagcaggagggaggccattaagctctcttttgtaagcaggatgtctgctttggggcgtgtccaaagggaaaaaaggcaatatgagaatagagaggtgtttaatttcagcttctaaaactgcacctgtttctttgagcaaaagttccctgtttggcaaataagtgtaaataatatagtaaattaacatttgagggaagaaaaccctaaaattgagatttttatgatttaaaatatgcctagcaagatattatttttttcaaagtacttattgaacacatagggttagagcataaagtaacatgcccagccttgtggcagcccgtgggcatcagcactgggtgtgtaattacagaggttacctgaagcctgaggaataagcacattacgttgttaaaacaaacaaacaaacaaacaaaaacacaacactgtgaaaagacagaagcactagaatttataagcattgatgattatgtaagaaatatctaaagaaagttcactgttaatattgaaaggtctaatcctggctatcttttaccttcagttctctacatttttttcctttttttaatcctctatcaaaattattatcttgacagacatgccagccttaatatgtgctcttgcttaaacagcatgagttccgtgctttatattgagactggcatatttaaattcaagtgcagacatacaggagcgtcctattttggccataagtgacgcaaagtccaaatcttaacactcttctcccaacaagcatgcattgaacagcagatatcagatgtcatcttctcaaagttttgctttatgccaaagttaccattaggattagcttagctctctttgaaggcaattaatgagaatggaagtgttaggggctggatgtttgtgtcccctaaattaatatgctggaaccctgttccccaacatgatgctatgggaggtggggcagaatggaatcagtgccctcagagagccacaagaccactcacttccttccctgctccctgccaggcaaagaaagaaggagaagtcggcttctgccaccaggaagagggccctcaccagcaccctgcgggcatcttgatctcagacttccagcctccagagccatgagaaatgaactgttgtagtttcagcgacgcagtccatcaaactttattacggcagcctgaacagggtaaggtaggaagtaaatgggaaacaaaataaaaaggggagagtgcctgaggtgtcatcagaagcccagcttgaggggctctgaggtatgcaggggcttttcatagttgtcaatgatgtgtgtgtgtgtgcacatgtgagtgtgtgtgtgtgcgcacctgtgtgtatgccagtatgtgtagtatgtatgtgtgtggtgtgtatgtgtgagtgtatgtcatgtggtgtgtgcatgtatgcatgttaagtgtatgtatgtcagtgtgtgtggtgtgtgtatgacatatgtgcatgtgagtgtatgtctgtgcatggtgtggggggaatataagcatgtgagtgtatgtcaaagtgtgtgtgtggggggggtgtatatgtgtgtgtgtgtggtgtgtgtggacatgtatgtgtgtaagagagtatgtgtgtgtcctgttagcaggagtgtccagggccaggtcactgaacacctccatatgcacaggccagtcgcacacaacgtggaattgcctgtgttgccggcactctcctcccaccgcttcaacactggaccacgtacatctatagactttgtctctgggcatccaattctccctcttagaataagagcacttgggttttcctttgaggagccatccctcatgggcatgagaccaaggtcatcacctctgtgcccctagacatggtgactcgttcacagataggcatgtgacatgacccttctcagggattttggagaaagaagactctttccccctggctactgagctactgtcactggggttgtgtgcaacgtgccatgctaggtatgccaaggagccaatctaaaccagagtactccaagagcagtaagactgacagcaagagtgagaggtgctcctgtcagagtttctggacaccttgatgcttctgggcctgaaggcagttactcctggagttttcagttctgtgagccaataagacttttttttgatttctgtttgtcacttgcaatcaagagttctgaataatgcaaattactgcacaaattcaaaactcagtttatagatgcaaaataaataaaattcaatattttagaattatgagtttataacaggcttataaatatgttttcagatatcagtctgctcaaagtctagtcgagctacaacatatgcacaaataatgtatttctattcacaaagccagtcttttcttcctaagtgtctcccctctcctgcaaatgtcctcttatccatagtccgggataaaggaaatggattattctaacggctgagaaataccttcccactggcatcgcatatatatagaaccagtggtaaagtctgtagggagatctgtattggcatggaaggagtaagtggggactccccactgggacttccattgtattttctcatcatatttgtaaagacctgactcttcatttattgttatcaaggcctgtgtgagtttgctaccttgcaatatcagaaattgaggaggaagttccctgccctgtttccccccgggatgaagttgcagatcacttggagaggaccgacaggagaggaaagaggaggcccctgctcctgatggcacagcaccccagggaaagtgatcaaaaccagcagaagcaacaaggaaagtcagctgtgccgagaattgcattgcaaattcattccacgcgtttgacctgtgagaggaagtgttccatgctttcatgttagggaaatttggccagactgggagccactgtccattgctccacagacgtggagtgcccactacttccttgtcagattgtcagacagtgtcctgaaaataagggacaacagtggatgtgacgaagaacctattttgaggacttttgttcagaggagaagcaacaaatggtacacaggtgatagggcttggatgtttgtcccctccaaatctcatgtggaaatgtgattcccagtgttggaggtggggtctggtgggaggtgaccaggtcctggaggtggacctcccatccccttggtgataagtgagttctcactcagttcgttcacaggagatctggttgtttaagagtctggaacctcctcttctctccctcttgttcctgctttccccgtgtggtgtgcgtgctcctgcttcaccttctgccatgattgcaagcttcctgagaccctcaccagaagctgagcacatgttggtgccaggcttttacagcatgcagaactgggagccaattaaacctcttttctttataaatagcaagcaaaggaataaaggaacggcagaatttcaaagaaaacacagaggcaggctgggcatggggaggtggcaaattcagagtgagtagtcaaaagcagccttctgggtgcatccttcctgaactacaacttgaatgacaagaagagaccagccaggccctgtcaatacctgtggacagaatcctctgctgggagacagtatgtgaaaaatctccaatcaggagcaaggagcaaactggactctgagcaggctgttgtggaacagggctgtccccttggccttctgtgagtgcccactgcacctgttccccttgcctggaatgtcctctccgcactttcatttttctttaaccaatctaaaggacaacttgtcactttccagggcataaattccctgacctctgacaggccaggtcccctgaaattccccgtacagcccccactcctgttgttcatttccagcaggtctcacaattgtaagcaggtcattatttacatgattacttgaggtcttccccaagaccataggcccatgagcacagacacagctggcactactgctcaccgttccaccctgggcaccccatctgtgccgggtctggtccatggcaatgcccaatccatccactttgaatgaatcagtgaatgaatgctcacagacagatacacccccatcttatccagaagacagaaattgtccgctgccatgacctcgggtgtgaagattgcagaaccatggttaggcacgctgccatagcattccctgagtatctcatgccacctgttctttgggccctaaggtgacttagagtgtggaatcagctcaggcttttccccaacttcagtttggtaaatgtctctcctggctgacacctgctagagggccagctcctcaggtgcctgtggagttggctgcatccctactctcagtggggactgccaacaatttaatggtaacctgaggagaccaaccacatctccagcatgccaggaagggagaaagaagcttctgtcctcttcactgctgatgaagataggcacatactgatgatgggtggccacagaaaagcattctaaatatgaggaggatgatgatagctacacccatgcactgtgcatgcccagccctgagatgagtgttttctatgcagtacctcatttaacccttaaaacaaccctatgagcagagtagtatcatcctcatcattttccagaggagaaaaccgcggaacagaagggctaaataacttacccaggatcacatagcaagaaagtggcagagcttgggttccaggtggtcccattgctgatactttcatccctgatagaattttgccacacaaatgatgacctgagcccactctgttcaccaacacctgttcttcctcaccttgcatgggcaatggctgcttctgcttctgcctacagtcaggctggaggctttcagagggaaggattcctttttataagtatggtaaagcccccggtggttgttttcctgggcgttttgtacttgaaatatttaggccctcagcactcacacctggccactgctttgcccctgcacctgggctacttcaggtctatgggaccagttgcggttagcgctagacaacaatgacataaaaatgaaccaaatgttccaaggatcagaagcatggactccacagactacttcaaagtgatgtgcagcaaggcacaagagttccaaaagccactgtggctggttagttccccattaagttgcttccttggttggctttattatttcatctgctccattagtgaacagcaagcgttttgcaaaaaaggcattgcacagcctcaccaagctcctagagaagcctttctagaagctgcttcatgtatccccacaaagcaacatgggcagcaggttggtgggatgccccactctcccgaagaagcagcagacttatccaggttaactccctcctctctcctttgtccccaacatgcactgatcaggaagatgaaaccaagtgaaagccacttcctgtgtgggtcttaaaattcaataaaaataatatctcagaaaaaagccagaacacactttctgttcagatggaaaaatgcatgtttccctccccaccttcacctacaagctgagttcatgttatttcaacagcacatcatggacccagatgcaaatggacagtatctgaaatgcagtcccgagcaggagaaatgtagtttcatcagcgagtcatttttaaggcttgatttctatttgtatttaaacatactatcaaaaaataaatacttgcatattttgtggaatgtctgttgaaaatatgtgcccaaagtgtctaacttgggacaaatctgacctcagtccctggaaggctaccttcgatttatgcctcttgatatggcttggctgtgtcctcaccaacatctcatcttgtagttcccataatccccacatgttgtgggaggagccaggtgggaggtaattgaatcatgggggcagttacccccatgctattctcgtgatagtgagtgagtcctcatgataactgatggttttataaggggcttttccccgcttttgcttggcacttgtctctcctgtcgccatgtgaagaaggatgtgtttgctttgttttctgccatgattctatgtttcctgaggcctccccagccatgtgaaactgtgagtcaattaaacctcttttctttataaattacccagtctcaggcatttcttcataacagtgtgagaatggactaatacacctctccactctgaatttaatttctttggtttggttttcaattatcttatctatcatagatcaaaacttatttccccagtaccttccttctaatacctttccaaatttttatctggaagtagaaggccccagtctcattctattaactctgctatcccatagccagcatgtttagagataccaaatacagttgctagagctccaggcaacagcactgggatccagtcactagccatcctctacagtgtctgaaaatgactcgttgcctcactcacttattcagcaaacacactgctgtacactagtccctgcactgggtgctgtcttatgacaatttccccagcctccagccttccttgcatttataaaaggtactgatatgcaccaactcacatcagtggattcagttacacacaatgacaggcagcatcagttgtgtttgtgcagggaagtggtcttcagtgctggtagaacataaaactcacttggaaagtttttcaaaatatgaatgctggagcccaagcccagaccaattaaagcaaatctctaagggcattggtatttgtaaaaatccacccagggggttgtaatgaacaaccagggctaagaacctgcagccttgtcactgacaataccagccttggaccagcagattcagcaacacctgggagctcattagaaatgcagaatcctaggccccacaccaagctactcaatcagaatctgctttatttaacaggattcctgggtgattcatgtgcactaaactgtttaagtactattctgggagattagaacataaaactttatctgttgaattaatagattgtattacagtgagctgcatgtcatatcattttcagaaactaacgtctgtgtaacagctttcctggaagatgagatcactccagaccacccagagatgcctaaggactccacttcctttcagtagtatagtccagtcaaaagatagtgattgggaaaaaaacaaagaaaagatacagaaattggggctaaaatgaggctctgtaatgaaaagattgtattgagttcaggaagcagttatatcacctccgtgccaaacacacacacacaccagataataaattccttgagtgcagggattgcgtatttctcttattcatagctatattcacaaagccaagctcaagaccttcacagagtcggtggtcactaaatatttcttgcatcacttagtgtcctgaacagagaacaattctgttagtcatttattttgagaccctagacgaatctctccacctctcagtggagagattttcagtgtcttatctatatgatctgtttaaattatttaccctaagatacaaaagcaacaaagagctcactgatgaataattatgtgatcaacagacacagggaaagctccttatatctaggagaactgtggactggtctccacacttccacaatccacgtgcccaaagagtaattagtacttggatactctcaacgtgtactcattaaatgaagagtcatggagttcctatgtgccagttactattctagaaattaacagaacagaccaaaatctctgctttcctgtagcttatacactagttgtctataattcagtcaccaaagtgttaaagaatataaagacagataaaattactatcattctattttcccaaatgttgttatatatatttttttttttttttgagacagagtctcgctctgtcagagtacagcagcttgatcttggctcactgcaacctccatctcccgggctcaagcaattctcctgcctcagcctcccaagtagctgggattacaggcgtgtgccaccacgcctggttaatttctgtatttttagtagagatggggtttcatcatgttggcagggctcatctcgaactcaggtaatctgcccgcctaggcctcccaaagtgctgagattacaggcatgagctactgcgcccgaccatgttattataatttttaagcctacaatatacttttcattttctaaggcttgatttttttcaacatatggctataataaaaaaaaaagtccaaattcaataccatcacacacatcctttaaaaaaataccaggacaaaataattatgattatgattttggaagttgtttataaaatacaatgtcacaatatagtactagttcaagttaattcacctaggtctttacttacaaataaaatcaattttcccatgcagctattttaagagaagaggtgcaatacgttttttaagttatttgtggtaaagtacatgtaacataaaacttactatcttacccatttttagaggacagttcagtattgttaactcggtacttattaaacaatttctcaatttctctttccttccagcccctggtaaccaccgttctaactttctgcctctgtaaatttgactgcttatcaagaccatcctggccaacatggtgaagcctcatctctactaaaacaaaaaaaaaattagctgggtgtggtggcgtgtgcctgtagtcccagctacccaggaggctgaggcaggggaatcgcttgaacccgggaggcggaggttgcagtgagccgagatcgcgccattgcactccagcctggtgacagagcgagactccgtctcaaaaaaaaaaaaaagtgactactttagatacctcatataagtggaatcatatagtatttgtctttttgtgacacgcttatttcacttagcgtaataccctcaagattgttgtggcatatgtcagagttctctttcttttcaagactgacaaatcctccagggaatgttatgtaccacatttgcattactcattcattgggtgatggatatttgggctgttcctatcttttggcgattgcaaaaaatgctgctatgaacatgggtgtacaaacatttccccaataattcatgtttttaagttagttctcagttgcttttgcataggtgacttagcattcctaatcagaacacaatcaactcaaacaaacagaagacaagccaaatgtacttttgtcatataacttgtacaagagaaaatagtctccattaaaaaatattgtaatcagattataagaaaatgcatcctgaggtaaaggcaggacctaaaaagaacttaaaaatactactttgccatatgaaagcctgagacaagcttaacgagacaccattcacatccacagtctagtcacatacgtgagtgtctaaaatttctcccaactgtagtctttgaccaggtttactttcctgaagaaatgtaaaagttcattttcctcaccacatgattttaggagaaaatccatgcacagttttaaataaagggatatttagaaagagatcaaagagagaaaaagacatgatccaaagtttgaacactgtaaaacttataaggagaacagataatttcttcaaaggaagaaaaggcgaacagactagcctgaacaaataaaaaagtctccatacactaacatgaacaaagaggcctggcacagtggctcatgcctgtaatcccagcagtttgggaggctgaggtgggtggatcacgaggccaggagttcgagaccagcctggtcaacatagtgaaactccccccccgcaccgtctctattaaaaatacaaaaattagccaggtgtggtgggtggtgtgtgcctgtagtcccagctacttgggaggctgaggcaagagaattgcatgaaactgggaggtggaggttgcagtgagccgagattgcactactgcactccagcctaggaaacagagcaagatgattccttaaacaaaaaaaaaaaaaaaaaaaggatgactatgggaaaaatggaaaaatagtttaaatttataaaaatgaactgacattagactacatggaaaccgtatggaaattgaatgaccattggaagtaagaagaatataagacagcagttctccaagaaaccacagtcagacagaagagcagaagggtgctgtattagtcatcttaggctgctgcaaaaaataccacaggcaggatggcttagacaacagaaagttatattttcacagttctggaggccagagtccgaaatcaagtttccagccactgtgtatctggtgaaggctctcttccaaacttgcagacagccaccttctgtgtcctcacatggcagagagagaaagagcaagctctctggtgtctctcccacttcttataaggacaccagtcctattgggttaggtactgccctgatgccctcatttaatcttaattacttccttaagtgcctcacttccaaatacagtcacattgggggttagggcttcaacatatatggcttttagagagggacataacatcagtccgtagaaggtgctcttggtggtctttagtttagcttaagtaaatttagcaaaattatagtgcctaataattactgtgagatgtcgaccatcaactgctatatccggagttggaagctggaaagagaggtccctgtgtctctttttgcttcaaaggccaaaactatccactttcttttattttgactaactggaaatcagccaacaaaaatgcagtgaagtcagtgataagtctgacctagcatgagtaagataaagctgaaggtgaaacagaaaaaagaaaacagcttgagcaaaggtaggaggccagagtagtatattcaaggaaggcttcagaaagatatttatagtgagcctaagtggctcacaggacatcctccgcacacacatatacaccaagaacagagtgcctaaagggctttgcctattattaatgctattcaatttctgattgataaccttaaataatagagtttccacacctattgatggtaccaacatgcactaaattccttacctgaatcatccttgatgactgtctttctctcacccccacatctaatctatcagccaacataccaaagcttccccaaacatctctcacatctgtcctttttttctctgtccccatgtctgccactcaagtcagtctccaccagcctcctactagtcatctaatggtatgtttgctctcccccgcacttttctccacacagcaacagcagtcacatcaatccccagcccagaattcaacagtttgccattatccctgcataaaaatccaaagctattgccttaaccaggaaggcccttcatatgcaggctggccctgccccatcccttccctggccacctcccatcctgactccctatccaagctcactccacttaggggtcttccaccaaccacagtcccctccacctgagcacccacacatggttggttgcctcttgttccatctttccttccacttcacagctggccatttggagttggctgtgatggtgtcttgttttacggtagtaaagataaaaatgatgccccccccaaaatacaaaaaatggaattagaatccaatgaaacccagtgtatctacatattagactttataaaagtagaaatttcagatttattcaagacctataaatgttgtttggtcctatgaaaacatctaactcatatttaaccctgaattgttgaactcaaggccttaaacaacctcaattttatgcaaatcacctctagtggccttacgttggaagtagttttttctaaattatattctatagaataacatgagtggtctggtggtatggcttggatctgtgtcactgcccagctgtcatgtagaactgtaatccctaatgttggaagtggggcctggggaggtgattagatcatgggggtggatttcccatgaatagtttagcactatccacaatatttttcagatggtaagttctcatgggacctggttgtttaaaagtatgcagctcctccctcactctctcttgcttctgtttttaccatgtgaactttctgctccagctctgacttccaccatgagtaaaagctccctgaggcctccccagaagcagctgctggcaccatgcttcctctatagcctgcagaaccgtgagccggttaaatctcttttccttataaattacccagcctcaggtatttctttacagcaatgtgagaatggactaatacatctaaaaagagaaaataaaaataaaaataaactaatttaattggttttaaaaagtggccacaatcactttgacattcgtgctgcatggaactgggttgctattgcttaatgtattatttcctaaaattttttgaaccagaatccacataatcttttccctatcttcctaatctctccatggacacagtttgagaaatgttggtcaaaaatatctcattttattagctgagaaggaatacactcaacttggagatgattcactagtcttaaaggaccattttatttgtggttctagtctttggccagaatttagagctcataaccaacagaaaaatgcttcagttgttgtagcattaatttttaaaatatgacatttataatctgcctattcctggcttggtcatgtgccaattgctcatgtttaaacatgtaatctgaagtttcaagtaaaaaatatgatttgtcttataggtgtttttcctcaacttttcattatagaatattttaaacacacatgaaggatataacgagtataataaacctccatgtaccatcccccagcttcagaaattatcaattcaggctacaacctcacccctggcaatggattgttttgaagtaaatctcaggtatcattaaaggtattttctttttctttttctttttcttttttttttttttttttgagacggagtctcgctttgtctcccaggctggagtgcagtggcgcgatctcggctcactgcaagctccgcctcccaggttcatggcattctcctgcctcagcctcccgggtagttgggactacaggcgcctgccaccacgcccggctaatcttttgtattttagtagagacggggtttcaccgtgttagccaggatggtcttgacctcctgatccacccgccttggcttcccaaagtgctgggattacaggtgtgagccaccgcgcccggcccataaaggtatttttaaaagctaactgtcagttaatatttgttactaagagtaaaaatgccataacttccacactcccacctcattatataaacacacacacacacacatgcacgcgcacacacgtacacacgatgcatgttcattaaaacgaataatcccagctgcttctgctgtggggctggcatctctgagtctatttcatggcatggcatgggaaggagtgttgacggatgcctcacatgtgttcggttactgttgataaggacactgtataaaatatttgccccagaccacggggactaatatggtagcacactttcatctgtcagattggcttgatccacacaaacctgtcaacaaaaccaggtcagcaggctggagtagagaagggaaaaatcaataaatctttgaattaatcatgcagctatcagagagaattatgggttcacacagtgaaatgtatacttgggcctatttgctcctttcttcttccagttattccttcatttccatccaatgtagagtccctcctatagaatccccacgccaataacttcgtttctgtaactaggttcaaataactgtccctaatttacagcttctgttccaccataattcttctaagaaagggttggagactaaagaaaaataagtccaatttaaatcacaagaaaagctgcattctaaattgctatgagtgttgcctctagtttttaaattcaggtcgtatatgttagtcacaaataaacaaataaatcttgccataaaactggatttttacatcctatataataacctgatgtgcacaaataattttactgaaccttcacagaggttctgatccttgtcaccttgaatatccttgctgttacacagagtttacaatgtttgtccctcgtgccgcctcctcaatttaactaacccttcaaaagagaaatatctttaatcacatatctatagtccttcctattctccttctgcataaccattttacaagaacacatatactctatagccactattagtaaaaagcagcatcgtcttagatccagaatttaagatagaagtcactatgaatatatttttcccaccaccaaaaaggtgtaaaatttataaactgatcaataactatgcaacaagtgtatattttaaatacatgaaattacttttccagtttcaccatttttcttgaaaagaaagtaatcatccatatccttactagcaagaaaagctttgtttttaaaaatctcaatacaaaactaaaaacacttaaatattttgataaaacaagagagaaacattcatcttatgtcaacaagtcaaagccagtaaaaaaagcacaagaaattcaggaaaatacacatgttcaggaccatcaactaagcatgtgcagagtcctatcaaagtcatgcatcaggcctcgcggagcccagaggttctgcatgttttgcatctgaaatggacttcaggctttcatggaaaaggtttactggagaaccctgggaggcacggccagcaataggatgttcaggttttctctacttagcgatggaattgtgtcgaattcagtaaaagaggaaatgcttgagacttcgattgccgtattgttcttttgtttgcttgtttttttgttttgttttgttttttaatttttaaaaatttttttacttagaggcaaggaatagagtagattcagcatcagaggaattgacttgatggggacacagtgtgggacacagactgacatggaaagttcgaacacagaatttactgaccttgaataaatccttgtggatcatttaaaaattacctgcaaggctgagatacacctttcttcaatatttcatcatgcatggtaagcatttggcaatacagattttttttaaagtcttgaatcctagaataacttttttaaagaacaaattacttcgcttggaaatcagaactgtggaaacgagtcacgtgcatccgggcctcgtgctccctggctctccaccgagggattcagcctggctgcgttccgttttgggaaatggccctcctcaatttcaagttcatttggctttttcaatgatagggtttcaattcaaacagataacaatgctgagaactaaaaatttcaccatctaattagccgggggggaatctcagtatggcctttctttcctagtatcatctgcagtttgaaaatgacttgatgaaggctttttataaaaaccctttacttttcctggtacaagaacaattgtagtgaaagatactggtacaatgcaatgggcataggaggataaaaaaaaatgtgtgcataaaaagaagcagaggaaaccaggacaaataagagatcagagaaaagagtgtggctgaaggtttcaaaatgcaatttaggttgaaaaaaaggaagacacgatccaacatctatatcaggcattttaatggagtatgaatccctggttaatctgggtaaggacaagtgggagccggggggtgagggaatgcagatagtcacaaggttgaaaggaagcaaaaaaggcctggactgttgcagctttcgatactggtgtgttcttctgaagatccactgccccatagcttttattacttactcaacatgtccatgatccccccaaaaagtcaagaaacattggcctaaggatatttccatctattaaaaaaatatgtatatcgactgaagatctatttccctgcctcccaaaattcatatgttgaaacctaaacctcaatgtgatgctatcgggaggtggatcctttggagggtgattaggtcgtgagggtggagccctcatgaatgaggttagggcccttctaaaaagagaccccagagacaccattcgcctcttctgccatgtgagaaaatgagaagacagctgtctatgaaccaggaagagaaccctcaccagacaccaaatctacccacctccttgatcttagaattcccagcctccagagctctgagaaataaatttctgtcgtttataagccacccaatgcatggtaacttgttaatgcagcccaaacaatctaagacaatatttatatataatacttttttttcagaaattacaggtaaacattttcagatatacaacatattatttgcattaaagtatattttaaatatttgatattgaagtaaagctcagttataagtttatttcaaaatgaatcattttgggaagtacagttttcaatgaacttctttcagaaaaataagtctttgtaattccttcagtataataagcctactgattataattaggttatatctggcgtgtttctatctcttttgtgtctttttaaaacaggtcatataatttttaaaatggcaactttaaaagcattgccttatccagaataagtgcttaaatgacagtaatggagaaattttcaactgaacacagaactagtgcagacacaaccaccacaaaatcccaggttggagtccctgcaccgccattcactgctcaggtgacttttcacatctgggtgctttcttcatctataaaataattctccgatgagaaatcggagccagtgatagagatgggaggctgatctaggtgatatttacatcctcatatgggcgcgtgtgggtgatctgattggctcagcagctgtcatttttgccatccctttcccccatgtaacctttccagggctccagtatccagctcaaaaagacaccctgaagcttctccacacagaaattctaccattcttagatccatcatcataaattggtgaagcatattgatcactatttgaaacaacatgccctcacacacaaaagctatccatggcaggttgacactctgtgctcaccaaatgtgtataaccctttagataaaaaactgaaagtaaagtctgaggctcgtggtgtggctatggattcagtgcatcaggaaatgctgtaacgcgcctctgaaggtctcggcatgtcagcctcgccttgacttgcactgtcctgctttttaacaaatgctgcagtgtaaagctgtaggtggttccaacaataaaatcatttcatgaaaataaaagaagacagcttttgttttgggaataataaatactgggaatttgaaatgtcgatttccctcagaacggcatcacgtaggagatgtcagctatgaaatcccaggctgcccctgattggccaacacaggcactctttgccttgggaggagaggctgatgtgaaatttgattttagagtagtagaaaaaaatatagaaaagcaaaagctcttattaaagcattaagaagaatttaaaaggaaataacaccaccactctcatggaaaagtttcttattcaagattcactccataaacatgtattaagcttctactatgtgtctggaatggtaatgttatcattcagtcgacaatatttgttggctcttatgcacgtacataatatgggaaactgaaagaaagtttaagaaaaggcaaaatctctatcttctagagagggagaatttcaagaaaggaccttgggtcacttactgaagctctctctgcctcagccttctcatctgtaaagtggggccgacaaaagcaattacttaatggggttgtcgagaagtttttaggtataacctgacatgtgcatgccatagaattgttagctattcaataactgacatgtgctacaagtattttaatgtaaatactaatgtttactgcaaatacatactctgatttagctgtgatggttaaggcaaaatataagatcctttcattctgccttattgtcattttatatcatacttttgctatttaagaaaaataaacgttttaataaataagtaaagagttgtttattttaaaatcctacagactattagttcaatagcattctaatgcttttatgttgaaattgaaggattttggattatttccccatgacttcttcagcataccttgcattttagcaattcttaaatagaactacttttcttttacttcctaacaagcctcacacaaacaacggcctatttgttttgaaaccacggtgtcctgaccttctggtttctgggatacaaacactttagacagaagataatgataataataataagaagaagaaggacaatgacaaacattaatgtcaagcactgtgctaagaactttacctatattaattcatttaattcttataacaatcttactataatgttatttttattcctatttccattttacagttgaggaaattgaggcatagcaaggttatatgactaactcaaggttacgtaacttggtccaggttgaatatggggtatggacctagacactggcttcaggctccacactatctacaggctctatagagaaatgcacacctagaggtccagaattacttagctatgttccaattcatggagcacctcacttggcctgaaactgcagttatggcactcttcatctttataaaaacacagtacccaggtccacagagaggtatttaactatggaaggtctcacaactgtgcagtagggacccaaagccaggctcctctgagtgcaaacccaagccctgctgtgcgctgctggcaaaatgaaagacatgcagaaacctgaaaccacctctaagagcacacaggatctgtgtatttttgcttatttactgtatctgtttatagcttcttttcaaagaacattttgactctgctctactgcagagcagtgtgtgctgtggattttctgttgctcataaagtccaattctggacagccaatattttcagcagcatcattgtattttcaggaactacacacactcaaatattctgtaaatactctcattacttctcccatacatgagccttggagagtcaatgcaactttgcaaatagaatttagttgttgaagtttcaaccacaggtgacgatttagccaataaaaattcagttagtttggaattaattttggaataactgtattttcaggaactacacacactgaaatattctgtaaatactctcattacttcccccatacatgagccttggacagtcaatacaactttgcaaatagaatctagttgttgaagtttcaaccacaggtgacagtttatccaataaaaattcagtttgtttggaattgattttgtaatcaagggtaacttttgaggcaattttttcatgcacatgttttcagactactaatcacttgggaaactgatgagtcgtttgtccattaacaaatttcccccttttccttttgaggaaggaaacacaggacttgaagatgcccaataaaccgtggcacccgaaagtgaggatctgaaatgcaggtgaagcagcttgcctgccgcccctgtgcttggtccaggactgcctggatcctgtcccctactggcccccagcccgttctgacacagaccaggctacttgcagctgggacagcggcagctggtggtgtggctgccagctggatgctggcgccgccggggacagggctgcagggacccacaggacctggcacaccagcactcctggctaccctgatggggctgtctgctttttgtttccttcccttaaaaatgctttttttttttttttaagaatctcattgagtatatatttatcagttgtctactgtgtgtccagcaggagatggaaagatataaaatgtgtgagagagggcaaataaagaattggaagaatttgtaatcatagtgggttaaatagcttcccccaaaaatgtcctttctggagcctcagaatgtgaccttatttggaaacagggttgtggtagatgtaatcatttaagttaccatgaggtcatactgaaataaggtgggcccttcatccaatatgactgttggctttattagaagaggagaagaaatgcaaagacacacacagggcaaaagtcacatgtcgctagagggagggactggatggagtgagacttctgcaagtcaaggatgccaaggagccaaggaccgcaggcaacaccaggtgctgggaggcctgacagggaccctccccagagtactgacagagaccctccccgcagccctctgagtcagcacagccctgctgacgctgtgactttggatttgcagacttcagaactgtgaggaaataaatttctattgtttgaaaccagtcagttcatggtattttttttttgtagtcctaggaaactaatacagtcatgatattgaaaaataaatgaataaatcaaagggaaattcctttgtggtcatggggaaggtttcctttgttggaggtggccagagggatgcgggggagtgaataagcaggaccaggagagaaggcaggtccgaagttggggtcacacaggtgcaagtcatggatgaagccctggaagatgatgaaatgaccaatacagaaagtggatgggattggacttttagattgacatacatttctgagaggggaagatgcaaactgaaggaaagagatagcaccgaaatattcagagagaagatcaaccaggcagtgtagttggatacaaaccaaaggagagcaactgctatgaactgccttgtgtcccctaaagttgtagatgatgaagccctaaccccaaagaaagagagaaagagagagaaagaaaaagaaaaaagaaagaaagaaagaaaaggaaggaagaaaataaaggtagaagagagaaagagagagagaaagagagaaagaaagaaagagaaagagaaagagagagaaagaaagaggaagggaagggaagggagcggagggggaggggaggggaggggaagggagcggaggggaagggagcggaggggaagggaggggaggggaggggaggggaagggagcggaggggggggggaggggagggaaggagaggggaggggaggggagggaagggaagggaagggaagggaagggaagggaagggaagggaagggaagggaagggaagggaagggaagggagacctgagcacctgtgtcacaagaaatacagtaattactaagagaagtaatttggagtatgaaagtaattaaggttaaatcgggtcataagggtggcccctaatcggatagaattagtgtccttgcaagaagaaacatgagaaagtcagtcatgtaaggacagcaggaaggcgtccatctgcacgccaggatgaggcccccatcagaacctgaccatgctggcagcctgatctcaatcttctaggctccaggactataaggaaataaattgctgttgtttaagccacccagtgtgtgatattttgttttggcgtccagagctgccaaatacaggaaccaacagaggaagtaggtcaactgtgtacatctaacagggaggtcagagagaaactggaccaggagacagccttgggatttaacatttggaagtcatgggtgatcttgaagtagtgaatttcagtagattgtaacaggcaaagcccaaaatactcactactataaactattatctcaaacagtttgccagaagaaagagaaagaatgaaaggagtgtgtgacagagagagagaaagaaaaaagaaagaaggaaggaagaaagtaaagacagagaaagaaagaagtatggaatttagcaaagggaaaggtttctttaaaactgggggacctgagcacctgtgtcacaagaaatacggtaattactaaagagaagctgtctgaagcaacagagggcacagctgatgaaaagaggtcctagaacgccggagcaggtaaggggaccaggagggcagcacggtgggaggctaagctggaaggaaagaggacagctcttcctgtgggagagaacgtggggctgagccatgaaggaggtagaaagggtcatctgaagaaagctgttctcagcccctgcagagtgaaaagttacgatcctttgaacactggagagtaggtgcagcagagttgagaatggggtgctccaggatgctgagaaaaagcttgggaaagacctcttcagctatacagacgcgggcgcaaaaacacctgagcatccagacaatcagtgaagagctggttaagaccgggccacgcacggtggctcacacctataatcccagcactttgggaggccgaggcgggcagatcacgaggtcaggagatcgagaccatcctggctaacatggtgtaaccctgtctctactaaaaaaaaaaaaatagccaggtgtggtggcaggtgcctgtagtcccagctactccggaggctgaggcaggagaatcacttgaactcggtggagaagaggttgcaatgagccgagatcgcgtcactgcactccagcctgggtgacagagtgagactccatcaaaaaaaaagaaaaaagaaaaaagaaaccggactggcataaatgctcaatgtgcccagtctgcaggaacgctccacaggctgacggtggagaagggaagcggggtggctcctagactgaggattccacaggtgacgcggttgctgaggagagaggaagtctgggctgctggatggtttactccatcctgccccatctgctcagaaggacagccacaaagggctgacagccatggtagctccgcctgagggatttctggaggccaagcaacccatctgcttaaggagaccttcctccacctgctccagcccagagcaaaggacacagcaccataagcctggtccaacccacctttatctctgctcgacaataccttgagttcacactgacttcttgagtagctagcaagttattctgagtcaaaaattatatttctcaatctcaaatcctgttttcttatactgtggcacattgtctaagcaaatcttgatttgtgacatctattttagcttgtcgataataataataatctaacagcattatggttatcactacacaatattctttcctaaatgatcctgttattctcttgaattttcctgaaatgaaaactcttagatgaacaacagaccagagaatatgcttgtgtccaaattacatctgattgacttagctggccatctgtttcccatgtctagaaagaaccaaacatcacggggagagagagaaagcagaagatccttaatggcagaatataaaatgaactccatttacacttaggtggagcaagggaagagtatgagtcaatgtgttttcagaccttaaaataatttgggatgagacctttcttaaggcttgaaatacttgggtacaaggcaataaagtacataaagcatagattttcttcatttgctttctccagcatttcatgatgagcatatgcaaagtgatcgttgaatgtatgaaaatgaagatgagccaacatcatttaaaaagttgcatggcacagagaagagttaacacagtaggtctgagactgtcagtcttatgaagggctgcttgcaggactgtcccttggctggtatctgggaactaggatattggcagcgttcccaccacccttagagtggctcactgcctgaactgcataagcaatacagttcatgatgagcacctgccttccttggggagtctggaactttggcacataccaaacataccagggtgcctacgtgacctgcccccaaaggaaaccttggccactgagtctccaggagctctcctgctcccctggtagacaacattgcacctcttatcatgactcattgctggagaaattaagtgcttcctagtgattccacagggagaagacccctgagagctggggcctgctttcctctgaatgtcacctcatgtgccttttgcctttgctgcttttgctccatagccttctcctgtattaagtcacagccatggatgcagctacatgctgagtcttcctggcagatcaccaaacctgagggtgggcttggggacctttgacatgggcatgtaacatcctgcaagattaaatctaagaaagtgaaaaaataactttgacagcagttggcttaagaagtggaatattcaatttggaattttaatatcctggcattgtattgtgggagaggactagagaaatcactgcatatccatgggaggaaactgaggcaaacaaaaacaaaaacaaaaacaaaaacagagagagatagaaacgcctttccctaggccacccagctaacctgagtcagcgctgcaatcaagtcatattccagaaacttaaaataggaaatcaagggggattttagtgtgactgagtggcccaacaaatgaggttttacacacacatacacaacacacagatacagagcacacacatcacacacaccccctgcatatatcacacacacacacatacagagcacacacaccacatagcacgtactccacacacacacacacacacacagagctcacacaccacacacagcacacactccacacacacaccccacacacatacagagctcacacaccatacacggcacacacacacaccacatatacacagagtacacaccccacatgccacacacacaccacacacactacacacacatacaaacacacatcatgcaccacacacacgtatgcacacaccacaccaaacaccacacacatatgtggacacgcacatcacacacatgtacacacacccctcctgatatcctctgggctaaatttgccccaatgctttcttttcttgttttcttttttaaagaaaaaatattaacatacctatctctatgtgtctatctacttgttttggtagttcaaaagtcaaaagcgtacttctctgtgttgggttgtactccacaatacacagtttgcagctttcagaatgggtgcaggtctcctcctggcaggctgaggccctgcagactagctgctattgtggctgctttggagccttgctggcagctgtttggagactcaggctgtgcccctcgccttacacgacccccattcttggtgtcacacaggggctctccagagctgtaaacaaccagcttttaattactttcaggtggcagcggggtaacatgcaaaacctaatttagtgagcgatagacttaaatggaaaaagtataacataattaatgatttttaaaaagaaagagaccagggccctctcttcctatttctcagttaattcactcccaaaaatatagcatggtaaaaacatgacatctctgtgcctttctaattccagtctgatgtgcacgttctgagctgagaatactttccagtgtttaaaatgaggttcttatttactaaaagcaatataaatagaagattagatgatacatacaaagacagatagctaggtagatgataacagacagaaaaatgttccttttatacttttcatttggtcccacgaatttcttttcagtgaatgttaaagaaatgcttctttaattctgcaactctctggcacttttaaaatcaaagatgaggctttcaggtgactctaggttttttttaaatttcacattattttaatgtttatctcattccttttactcataagctctttgagggcagactcaggtctccgcaagatagcagccacagcatagcagatgtctggaaaatgctcagtgaggagcaataaaatcacaatagaagtgccacagaaagggaaggttaacttctatagtcaagagtgcacaaagcagaggccccccacagcatgaccctcaggtccccccgacagctgtgctagctctccctccctccccacatgagaatacggcatccaatctgctcttagttctggtttgctgaaacgtgcttaagggcagccttgtctaatttggttggctgtacctataatctcttttcccctctctaaaatgcaaaggttttcttaaatcacaacctcctttctgaaaccttctctacttccccaggcaaaaccgtgtgtgtagctacagcctcaggccctaagcgcctactgcagcacttaacaccccaagagggacagtgcaggaatctccccaagcatctcaacagcagaaaccatctctgcaggggcctggggagggagtgcttcttaaagcccaagtcttgcgtgatctatgatgcccagacccagttgtggcagtgaagaattacagccaatgtttcatgtaaagtggttggtttatgtcctttgatatttcatgtgggcagaaaattgttcacgtttagccaaaatacagaaagaagataatcatccttcgacctgaactcaatgatcctaagaggtaaaattctccttgaatcatcactaatagaggtattcagataggaaatattacagcagaaaattgggccactgctaaagagggaggcagtttctctgggaatagtaaaatgtttgctttttccattttccaaatccggttacccctgggctgtgtctttgatgttaatgtagctaaacccctggtgagattctcacaattttatcagaagaaacagaaacggaaggctgggctctcttactgctggcctccctaatcgggaggaaattcacaacaggcttgtgaagggaaacccaaatataaagccggtgttattgtttttttccaggatggtgttttatgtatctccacatcagcagtacctccaaaagcatgtcattattcaagctactatatttttactgggctacattaatattatggcatttaaaaggatttcattgcagcttaggataagtgatgaggatgtctaaaaaaatccacatagacatcatgactcttgttcttcctggctcattttagggaggtaagaacacaataggtcaggatctgtcatattaactgaggtcatctgatggcaccttgtgtgcctgtctctgaaatgcttttcctctgcacatttacgaccccacccccatccatcataccagagggaagggtcaccctgtaaggccccagggcccagggaagagctcaggcaggcagaaaagcaacatcagatattatgaatctttcctccatttggtagaattatgggatttctacttttcagctgttggggtattctttccaaaggtcactccaaatcaatgaactcattaatgtccttgataatggtagcctcatggcctcatatgatgaagaggcataacttgattcctgcgtctaccttcaggccaaccgaagcctgtcctggaaagaaatcaatgcaggccctaatgtgcagtaagctcccaaaaggaaccatgacaatatgcacaacactcattaaaccctgacaaacactgcatttgtgcttctcaggaaaataaactactcatttgttttcttaaccaaaataaagggcaaaacctagtgagacatactaatagaaaccattttgcttctttttagggaaatacacaaacatctttaattttgcttttcattaaaaaagaatttgtagaagacaaatacccatttaccttcaccaggatttccaaaggtcccctggcctagagattcacagaaacccaaagctcatctgttagaagcaggtctttgctgctccgaccttcccaggggatctcccaacagtcaaggctgagcagctaagcatcccccaggctgacaggtcacacttcgccctgagcccagtggggcacgttgggccatggcctgtgaatcatgcttttgggccctctcttgactgccatcagctctcagctatcctaggtcaactctctggcactcccatacctgctcctaactcactcacttagtaagatacttacacaggcttatttccatggctgatttagttaatcgcttttctccatggaaagaatcaaccactgaaggaagtgatctctgcagagtacgaatgcttcctggaacaaacttcccagccagatcccagcaggctgggatgacttgataatccgggaagagggacctgggagatggccatgccaaggaataaatccaaactagctcgcaggagttacagtttatatacaaagcagagacaaattaaccttttacaggtcatctgctgtgcatatggcattcaggacagcttccctgaaggtcagggctaatttagaaaaagtccctctgttcctgggacttctgtgctatgcaaggtcgttccctgaagccaagaatcccagtgcttccctggagtggctcagccccagccagtgtggagggagggagggtcttccttttagcggcctccaccccggcacagcctgggtgatgggggagggaggctgtcctctgtccttatctgtgccttgtgctggtaaccagagagaaatataacccttctccacctaaacctcctgagcatggtttatttattaagatctccaatgttttaaaccatgcgtcacctccagtgacttcatgacctccttttctgggcattgctgatgggtggagctcagacactgggaacagggtctgactgtagcagtgagcaacagaagtcaggtaaaatgctcaatttccagactttctattagcagatcatgccactgctttggggccttgttgtcatttacaaggtcatttttagtgacaagtctattcgactcaggttgaacgacctgatatgaagtctctctctccctttctttcagtgatttacttacaaaccaaccaaagcttcttactgatgtattccttaataagataaacacctgtgttgtatttattttctagatgctgttgtgaagtacaaaccaagcacttctccaaaacttttgcatttaaaattgtatgaaaggatgaagctccagtatctgactgaggagaggacatgggctttaacagttcctatcagaggggcataaattctatattgcatgccagcatcatcccctcactagatacacatttccttttttttatttagttaggttcacatttgaaggaaaataaagtctgttcacagagattgcaaaaaggtgaaacaagaacaatgaggatgctgctaattaaagatgtctaaaaacaaaagaacacacgtattatgcataaccaaagagattcaaaaatcctcctggtagaacatgttctcacttgtaagtgggagctgaatgatgagaacacagggacacatagagaagaacaacacacactggggcctacttcggggtggagggtgggagaaggaagaggatcaggaaaaataattaatgggtattaggcttaacacctgggtgatgaaataatctgtacaacaaacccccatgacacaagtttacctgtgtaaaaaacctgcacatgtacccctgaacttaaaataaaagttaaaaaaatcctcctggtagatatttcaatttctcacccagatttccagttctcctcttccttcaggcacatgccccattgaggtcaggcatggccatgagacttgctttggccaattaaatatgaacagagataacatgtgtcacctccaagtggaagcactaagaaggcgtttgtaattctcccatgctctcttcctctgccagagcagaccatgaagctgaaaatttggatgacagggttaaaagatggtgaagtctctatcctaggtcaccgagtccggaagattgaaaaggtagctcccaattcttccactccctgaacctatactcccttgccatataaattggagggcctctcccctttgattccgagcttagccagatgactgtcatcaaatccttccatttgccattaagacaactaacatgacccctaaggagagaagatgaagatgtttcaacactgaaaattagcaaataaaaatgtataagggagtctctattctgattattacaatcgcatttgagttattaagcttagtatttttcaacaccctaagttaaattatgataattaatcaacataacagcaaggaatgtactgttcattgaagtgtgaggggttttgaattcactgtaaagacaatgttttcataaaaactaagaattccattctatcctagattcctgtaatgtgctatgatggcaatgtatttcaactttgatttggatcttttaaatgcctctggtggtggtgtacagtaaccaacctctctagctaatcaataagctgagaaacaaaaacggtgtgtcaccgtgagggtttagttccaaattctgctctctataaatggataaaatgttgcttagtcaagaagtctgttaacatgtgtgttgtgcgtgtgtgcacccgcatgtgagggcatacagacatgtctaaaaaaggcaactatttataatccacatcggaacacagactatgctcctcacaattcttttccgaaagcagccaacacattttgagatatgccaacagtcattatccaaggatgtaagaacaggagcaccatgcatcacgcggacagtcgcctttccaggtaaatagcacagagcaagaaatcaacaccattagaaatgaagaactgcagtttcttggaggctaaatttaaattttgtcttttctacacaccaaatataagccaagaaattattcatatgcaaatatacatttcattgctacatatatattcttagtagaatcttcaagaaataggtcagagatacaacataactctcaagacattggaaagcaccaaaaggtcatgaaaacagggcttccattttccagattttagtttcagaatgtcagctatatatgcaatgctgaggtctctcacagatgcaaaatactactaccttgtttttagaagcagacgtaaaaccacaattttctcaaaaaagttaacacaatggctacagttacagtgccggtaactaatctctcttcatcagtcaacccaccaaaggatgtctgaatcaagccattataagccaatacaaaacacttatttcaggtttacttacaaaatagcatcagccttaagaatactaattctgaattatgatgaacacataaacggagacccgattccatctctgaaataaccttttcagaaggtgagcgtggtgtcctgcaccctggagacgcaaagcctacctgagacaagtgaaacagtgtctttctcccatgagacgacagtgatgtacgcctccaccgaggaggggataatgcacttgaagaccgcaacattgcctctcatggttttctggtcctccacacggactgtatagggctcccgtaaaactggaaggcagaaagaggacgtcagtaaggcacacggtcaacaggctcattctgagagtatctcactgtaatatatacactgcagcacacacacatcaattgcataacatatctttctggaaaacagttaagatgcctacatttcacgtctttcatcgcctgacttaagaaaacattcattcccttaacaatacatagctgggtaaggtggctcatgcctgtaatcccaccactttgggaggccaagatgggtagatcccttgtgcccaggagttcaagaccagactgggcaacatggcaacaccccatctctactaaaaatacaaaaaaattgctgggcatggtggtgtgtgattgtagtcccagctacttgggaggctgagatgagattacctgagcctgggaggttgaggctgcagtgagctataatcatatcactgcacccagcctgggtgaagaaaaaaaaatacactacactttataccaaggggccagagtataatcgaaaatagttaatagaccccctgaaggtatcatgagataggaaatagcttcatgaaagaaaagttactggctctgcaaagttatgatgatggcaaactgctattagtcctctaagggccgaggaagatttttttttctgactgcaaaaaatgaataaaaaattcaggcaaggcaatttttctgggaagccttgagaactctgagacaattaaaataatttttcattagtaaatttttaaatgacagttgcaaagcagtttgggaaacactgatcctgcttcccattgtttagggaaggatgttgattagacagcctgcccaaacactccaatgataggagcatcccagaaagactgcagagtggacttccacgtccttgatgtctaggctcagaggcagggtggtactggtgttcaaaacctacctagcaggcccaactccctgggttcaaatccaagctcggccactccctgactgtggggcagtgagcaaatcctctcaccatctataccatggggatgatgttggtagcatctgccccctagggtgactgtggtgaatcagttaacgtaggtgaaaattcaacagtgtctgctagaagcaggttgggtaaggccacacttaccaatagccagagatggatccccagggttggggaagatctgtctccagggaagtaagacactgatgaatatagtcccaattagatgtgccagccttacttctttagagctttgttttcctcaaatttaaaatgagggcattgtggtgggaacctcttcaaggtctaaatcttataagtctatgattttctaagatacccacagagataacttattgtctaatcatctaaccacctcacttaaagaattaatcacttactggacaaatatgtgccatgaaaatggtttcaaaaggtactaacacaccaacaaagctaaaggtgaatttctcaagggaaatctcccagtaggcagaggtgagctctttagaagaggactgttaaggtcgggctaaccttgtgatatgctgagcatttttgtagtaaagcatgtctttcatgaaagccttcctctccagtttccatttttaacattagccgtttttccccaacttggagaatttcttcattattgtatctaaccagagagatttttccaagtattgaaatcttctgcgacccccatcactgtaatccccaagcggcatgaggtgaaggtccaggcagcaactccacacctcctgcaggaggtccactaggcaaaaattcagggcgcccaagagactgacctcagcaacaacatccttacaccgagaggagggaactgactttgtacagaaaggctcctgcataagtaaacctttgctgggagctgaggtctacggtaatagattagaaaaagactatgaagatataggcaaactaatcaaactcattggtgagaatctgggcatggtgagaagcagaagacagagaggagaagaggaggatggaggacagaggagaaagagggactggtcaacagagagagtctaccgtcacaggaatagtgcccctaagcaggggaatgatttcaatttaagctcctttgtctgtgtgatgcttgtttctttgcaataaaatcactctgtctccccaaaccttccgcagactttgcttcaaacattaatgactcaagtaggataatttttaatagaaatcaaggaaaggggtcaagttccatgtatcagacaggaaagtgagaagaaaagatgttcacctgtttaccgggagacacgggaaatgccttcccaccaggtgtacagcctacactagatgggatcacaggagccataaaaatatggggtgactgaccggggacattcccagtgttaccacccaatgtccagtgtcctaggaaacccctcagtcccagcacttacccacatatcatggagttttctcctctctagctacccactgccctcaccagtaccaggacaccttagtagtcacaattttaaacctgtgtgacttttgcttctccaacctccaggtcagtcccaagaagcccagatcttctcaaagcagggacagcactgtggtgatctgaaccccagctcgctcaaagggaatggggatcagaagaaaactgcacactccccatcccttctccttattcgattactcattccacaaagatagcctgtgcagtgagcctttaaaaaattatcttagaaaatacttggcacacaagaggtgttcaatacatattttgagactgaatatatagaaagacagagcttccattctgggagaacttctaatccttttacagaatatacatgtatgcacatttgaatttatagccactatctatagttttttaaaaaaatgcaaatcagggttttattaaagctcctaatctttgtaatagagcattgtttgttcctgaggcctccataacttaagacaccaacattgctgtctatggcgatatatctctcagagggccatgtgagtttcctgagcccatagtcagccccgaagacaggggtgcagccttgatcttcattctacatccaactactgctaactttgttgcagtaacagacactgggctagaaacctgagatgcaggcaaaaaaaaaaatacactttgttttaaatttgattgacatttgcattataagacagagtattatctaagtactgtgcttggtgtcataagttaggctctccccagagagcccagatcttctcaaagcagggacagcactgtggtgctctgaaccccagctcgctcagagagaacggggatcagaagaaaactgcacactccccatcccttctccttattcgaccccaaaaggaggagctgggttcaagcgactgagcaaggacacaatcccctgagaggcagggaaagtgtgagtagggcagggagggaagcagcaaagcaggtgtgtggtttcaggtgaagtcccagccacacctgacatgctcggtcatgcagaggagctgggatcccctgttgtagctgtctgtcattggcttagggctggcctcaggaggatggaactcccaggcatttcccactcttgtttctgtgaatggttccagtgcccaagcaatcctctgaaggctgcaggttcatgttcttagcaaccagcgcgcagatcttgggggatctgattcagggatgccagtagggtccactgcaatcattttagccttcattcagtaaaatctgtcatctttttagatcagaagaaaaaaaaatctctggtaatatgactttgaaacaaaatcaggcctatttatttttttaatcaaatattttcattgtgatataagagttgtacatattctggggtacatgtgatgttttcatacctgtataaaatgtataatcataaaatcagggtaattggaatatcaatcacttcaatcttttccctgtgttgggagcacagtaaatcttttttcttctagcaatttaaaaatatacaataaattattaactataatttccctactgtgccagcaaatgttagaacatattccttctatttaactgtatttttatacccctcagccaactactctttaacccctctcctcatccccttgcttcccagcctctggtatccaccattccactctccacctccataagatccacttttccagatcccatatgtgagtgaaaacatgtaatgtgtgtctgtctgagcctggcttaattcacttagcatagcaacctccagtttcatccatcattatattcttgttggatggagagtttgcaaatattaatagtctccccattctgcatgttgtctcttcaactttgctgatttttattttctttgctgtgcagagtttttctgcttgatgtaatcctatttgtctatttttgcttttgttgcctgtgcttttgaggccttaccccaaaaatctttgcccagactaattttctatagtgtttccctagtgttttctttcagtaatttcatagtttcaagacttagtttaagtattttgcccactttgagttgattttcatacacagttaaagacagggatctagtttcattcttttgcatatagatacccagttttgccaacactaatttttaaagagcttgccctttcctgaatgtgtgttcatggtacctttgtcaaaaatgatttgggtataagcgcatggacttatatttggattctctattctatcccattggtctatgtgtctgttttatgtcagtactatgctatagtatgccagtactacacctgtgttgtattctttgaaattagactgtgtgatacctacagctttgttctttttgctcaggattgctttagcatttcggagtcttttgtggtttcatacaaagttaaggatttttttttctatttctgtgaagaatgtcattggtagggatggccttgaatctgtagatcactttgagtagtatagatattttaacactattaattcttccaatcaacgagcatgaaataactttccattttgtgtgtgtgtgtcctcttcaatttctttcatacttctttatatttttagcatatctactataggtttttactttgtggttaccatgaagcttacgaaaagcatcttatagttataagaagttatttaaaactgaaatcaactttactttgattacacacacatggcttatttattgagcaagagatcacacggttggtctacattgacagcagcgaatgtgagaaaacattttaaatggtccattttcaaggcataataaatctaagcactggcagccagcctgcagatgtaacaaattgcatggctcatgcacctagaaggtcacgataagcaaacagaatgtagacgaggggtcagcccataaaagggaagaaagttttgttactgggaaatcaaaacttaagtggggaaggggattgggttataactttaaaagggggataatgaaacttaggcgatgtccaggaagattgtaactccatagtactcaatcaatgaggaactgggggagggacttgcttgctaggcaataaattacctgctctacctgccctgggtgtgcctgcctaacaggcgcctgatcttgcatcaaaagtcttgcttaggctgggtgcagtggctcacatctgtaatcccagcactttgtgaggccgaggtgggcagatcacctgaggtcaggagttcaagaccagcctggccaacatggtgaaaccccatttttactaaaaatacaaaaattagccaggcgtggtggcgcatgcctgtaatcccagctactagtgcggctgaggcaggagaatcacttgaacccgggaggcagaggttgcagtgagctgagattgcgccaatgcactccagcctgggcgacagagcgagaatccgtcttaaaaaaaaaaaaaaaaaaaaaaaaagagtcgcttctgctgttcttcgtgtctctgagtccattctttgcatctggatggctgtatgtgcgtttctcacatgaaatactcattttattgtacttcggagagattatgttttttacaagttgaagatttgtggaaaccctgcatcatgcaactctatcagcaccatttttccagcagcatgaactcactttgtgtctctgtgtcacattttggtaatgcttacaatatttcaaacttttaaaatcattatatctgttacggtgatcattgatcagtgatctttgatattactattgtaattgttttgcggagccacaaaccacatttacagaagatagcaaacttaatcaatacaggtcatatgtgctctgcccacctcactgacatgccattttccgtctttctccctctcctgaagcatccctttttttgagacacaacaatactgaaattaaatcaataaataaccctacagtggtctttaagtattcatgtgaaagaaatggtctcatatctcttactttaaatcaaaatctagaaatgattaaacttagtgatgaaggcatatcaaaagctaagacaggctgaaagctaggccttttgtgcatttagccgagttgtaaatgcataggaaaagttcttgaaggaaatgaaaagtgctacttcagcgaacaaatgataagaaagtgaaactaccttactggtggtgtggagaaaatttgagtagatagaagatctggagagatgattaaactagccacaacattgccttaagcgaaagcctaaatcaaactaagtccttagctctcttcaattccagggaggcttagaggggtgggaaagctgcagaagaaacactggaagctagcagaggttggctactgagatttaaagaaagaagcaatctttataacatacaaatgcatggtgaagcagcaagtgttgatggagaaactgcagcaggttatctagaagctccagctaatgtcaatgatgaaggtggctgccctaaacaatatattttcaatgtacagaagatatccttctattaaaagaaaatgccatccaggattttcatagctagagaggagaagtcaatgcctagcctcaatgcttcaaaaaacaagctgattcttgttaagggttaatgcagctgatgactaagatgaagtcaatgctcatttaccatttcaataattctaaaattatttcttagaattaattatgacaaatctactttgcctatgctctagaaataaaacaagaaggtctgggtcacagcacatcttcttatagcatgtcatgttgcacaggatagaacctccaggacgatgtagaatagaagtggtgagagcatacactttgatattgttcttcatttgggggtgaaaacatttcatctttgacaagtatgatgttcgctatagcaggattttcgtagttgctttttatcagattgaggaagttcctttctactgatggttttctgagagttcttttaatcattagtggatgttgggtttcatcaatgtttttctgtgtctgttgaaatgatcacatggtttacactgattaattttcaaatgtgaaactcaccttgcattatgaatataagcctttgtggtcataatgtattattccttttatatgttgttggattcaatttgttaaatttttagaatttttacatgtatagtcagaagagatacttgtctttagttttcttatgtcttgtttatgtattagggtaatgctaacttcataaaatgatttgggaaatactctctcctcaattttctggaagaatttgtttataatttttattctttctttctttctttttttttttttttgagatggagtctccctcactctgtcacacaggctggaatgcagtggcacaatcttggcttactgtaaccttcgcctcctgggttcaagcaattctcctgtctcagtctcccaagtagctgggactaaaggcatgtgtcaccacacttgactgatttttgtgtttctagtagagatggattttcaccatgttggccgggctggtcttgaactcctgacttcaagtgattctcctgccttggtctcccaaaagtgctgggattacaggcatgagccactgtgcctggccaaaattattatttctttcttaaaggattagtagaattcaatagtgaagccatttgagccaggaattttactgtagagaatttttaccaataaatttaaattctttaatagatatagggctattcagtttatctgtttttccttgagtgagtcttgatagtttgtgtttctcaaaaaatattttatttcatctacttttcttaatgttctcttagtatcattttaatacctgtagaagataaagtgacgttatctccctcattcttggtattagtcatttaccaactctctcacttttctggtgaaaaacacaccaattttaacaatttttttaaaagaacttttagtttcatagatttcctctattgtttctttctgttctataatttattgatctccattctgatcttcattgtttgctttctgcttatagttttagttttatcctctttttcagtttaaaatggatgctgagaccactatttaagacttttttaaaaatttctaatataagttttttagagcaataaaatctccctatttttttagtggcactccccaaattcatatatattgtgtgttcatttcttattcagttgaaaaaactttctaatttccttcttcaaatttttttctgaatttttttttttgacacagatcatttaaaagagtgctattcagtattcaggtacttggttatttctcagagatgttattgttagtgatttaatttcattatgatcaaacaacatattttatacaacttgaatttaaaacaaatttatctgagatttgttttgttgctctgagtatggtctatattagtaaatgtctgtgtgtctcagaagagaatttatattgtgctgttgttggatagaatgttctttatttaaaggtcaattacatcaaattgattgatagtgtcattcacgtgtttttttgttcttactgattttctgtctacttctaccaattattgaactaggagtattgaaatctccggctataatttttgatatgtctgattctcattgcagttctatccatttttactttatgtattttgaagttttgttgttgggtacataaacatttacaatagtcatatcctcttcacctcccccctttacattatgaaatgaactgctttagctctgagcacaggggatttttagggcagtgaaactgttctttatgatactgtaatggtgatacctgccattatgcatacaacttacaacatagagtgaaatttaatgtgaactatggacttcagttaataataatgtataaatacgagcttattgtcacaaatgtatcacactaatgcaagatgctctgagcaaacagtgtatttgtttggaaatacactttgcttaatattaatgtggctattctagctttctttcagtggtttactttaattaggttgatttgatttgatgaggatggtatatcatttttatccttttacttttaagctatttgtgcctttgtatttaaagaatgtttcttttaagcagtgttaaatccaatctggcaatttctgccttataattcaggttactggaacatttaaatttaatgtggatattgatacggttaggtttatcattttgctatttgatatgtattttttttttaccgtgtttcctttttcttatcattttcttctttgttttggattgaggattttttaatgattctattttttctcctttgtgggcttattagctataactctgttttgttattttagaggttgctttaggttttgtagtatacatttgtaacttatcaccatctatattcaggtgacattacacaacttcacatatagcaaaataacctccaatattacactcccatgtcttcactgtaggccttaatgctattgttgctataagttttacttctgcctatgttacaaactacctaagacattgttactatttttgtctaaatagccaattattttttaaaatattgcaattttttaaaaaatctgatttagatactcatgtagttaccattttcattgcagttctttcctttgagtagatctaagatttgatcaggtgtcatttttttcttctgattctagaacttcctttaagatttcttgtagtaggattcagctgatgataaattttctgctattttgtgtctgagaaagccttcatctcaccattattttataaatttacttccactcttgcctgtaatcctagcactttgggaggccaaggcagggcaacttcttgagcccaggagttagcgaccatcctgggcaacatagcgagattccatctctacaaaaataaaaataaaaatcagcctgatgtggcggcatgcacctctggtcccagctacttgggaggctgagatgggaggatcacttgagccagggaagctgaggctgcagtgagcgatgatcaccccactgcaccccagcctggttgacagagcaaggccctgtctcataaaacacacatatacacacatccacacacacacacacccaacagcaacaacaaaaatcctgtctactgtcattcttatctttgttcctttgtgtgtaatatgcctttcttctgtagctgcttttgatattttattattgcgctgagcaattttattatattatgatgtgcctttgtgcattttttcttcacgtgtcttgagcttggggtttgttgagctccttggatctgtgggtttatagttttcaacaaatttggaaaattttggcctgcatttttccacttctttttaaatttcaccatcccttcccttggggcttaatttgtcattaagcttcctgaagcatgttttaatttttttgaataaagcttgatttttttttagagcagttgtaggtttagagaaaagttcacagcaggttcccatattctccctcttgccacatcctttaatttctttcattattatcatcttgcattaatgtgatacatttgtgacaataaactcatatttatacattattattattaactaaagtccatagttcacactaagtttcactctatgttgtaagttctatgcataatggcaggtatcaccattacagtatcatacagaacagtttcactgccctaaaaaaatcccctgtgctccgtctgttcaaccctccctccctcctgactatcccctggaaactactgatctttctactgtctctctagtttatctcttccagaatgtcaagtaggtggaagggtatactatgttgcttttccagactggcttctttcacttagtaacaggcatttaaatttcccccatatcttttcatagcttgatagcacattttttctatcgctgactaatacttcattttatactataatttgtctaatgttaaagaaaaattgtagctgggccctgtggctcattcctgtaatcccaacactttgggaagctgaggcaggcagatggcttgagcccagaaatttgagaccggcctgggtaacatagtgagaataccctctacaaaatttttttttttaaagaattagccaggtgtggtgacttatgcctgtagccgcagctacttgggaggctgaggggaatcacctgagcccagaagttgaggctgcagtgagccacgatcccatcactgcactccgacctggacaagagagggagatgtcctctcaaaaatattaaagaacagaaaaaaatgttctaacacttattaaaaagataagattatattcatgtctgttccagtaggagtcatctatgatgactgcaacagggaagggtaattcaacttcatattcaacaaggataagtgagggtttatagccaatgaacacagtgaggggagcagtgggtggaaaattagaaagaggagacatcaagggatgaggattcttgctaaactggcctaacagattcttgctaaaatcaggccaaacatgtatacatcaaagatgggactggaagaacttgatcagatattaagagtgatcaagtatcaagagtaaggggatgatttagcaggattcttgctaaagctggggacaagagaccagatgtgaaaagctaaggttgagaactagttgagaggagggctcagaggagcctttccaaagttagtcaaggagagattctttatccccatccactcacatactaaacaacatctttgttgcttccatgttttggcaattaggaataaagttgctatacaaatttatgtgcagattttgatattctttatcccaaagcataaggcaagcataggacacatcttatttccagctccttaaggaatgctttcctctactgcctgaggtccagtcttgaaaatggttgcttcagatattttgtctgcatttttcgttgttttttttcagttggttgtattagtccattctcacactgctatgaagaaatacccaagactgggcaatttataaagaaaagaggtttaattaactcacagtttcaactgcctggggaggcctcaggaaacgtacaatcatggcataaggcacctcttcacagggtggcaggagagagaatgaatgcaagcaacggaagtgccagatgcttataaaaccatcagatctcgtgagactcactcactctcacgagaacagaatgggggaaacttaccccatgattcaatgaccttccactgggtccctcccaggacccatggggattatggggattatcattcaagatgagatttgggtgcggacatagagttaaaccctatcagcctcaggacactggtttttggttgtttcagataaaagggtaaatgtggctcccacacctccatctcggccacaagcaaaagtcctagtcaaatgttagaaagcagtttgtggccggggtcgctcatgcctgtaatcccagcactttgggaggccgaggtgggcagatcacgaggtcaggagatggagaccatcctggctaacacggtgaaaccccatctctactgaaaatacaaaaaagttagctgggtgtggtggcgggtgcctgtagtcccagctactctggaggctgggcaggaaaacggcgtgaacccgggaggtggagcttgcagtgagccgagatcgcgcgactgcactccagcctgggaaacagagcgagactccagtctcaaaaaaaaaaaaaaaagaaagaaagaaagaaagaaagcacagtctgctaaggagaaaacaatcatgagaaatcttctgacttgcccaggatcaggcggctcattgctacttgctctgtagcaaaggcagcctgggtaaggagcaatactgtctgaagtggcccacctgcattccagcccttagaacaggcaagaaaatatcttatgttaggactaggattgatgattaatgagacatgatgagtaaaccttccttcaattgctagcacccagacctaggtcaaaatttctgaaatttaagaatgagaatcccttgtgctgccaagggaaagattatgaagtcattctacctaatagcttattccaggaaaatccaaacaccaatctacagggatatttagacatttaggatgacctgatacagaagaggataccccgtgagtgagcagtcatcaccctcaaacctacccttcagctgtcaaagggtagcatttatgcccttcatctgtctttttgaacaagcttccagttctgtactcatatttacataaacaggatgaaaaaagattttcaagtatccagtgaacaacctaaaagattattataaccattatgtgttcacaataaaaagcaaaatgaaatcaggagagaaatttgatttgggtaatatgactgcccatcttatatgttcaaactgatacagtagtcatccatatgctggattcatagtccatagggtttcagatgtcaagaacgccagcacataaatagtaaaagcacaactgggtaggaagaggcaggtagcacagacgccagacaagatgatgcaatgtccatgctctaaaactttcagtgtcatgcaaaaacaatgaattctatgactaatttagaagatgatagttaaaacaggagtaagcatttcattcctttatctgacagaaaatccaaggcagacataatggattaatacgcacagatggagctgtttgaaattctaggtttccctataagtggtgttttgcagattataaatacgcttttataacacatcattaaaatgtgcagtcttcccagtaaaagtcattcactgtatctccctgtttgtcaggtttagaggtccctatacaaattgcattgtaattatttgacacatcaaattttcatatatcttgattaaagacaatcctttttttctttcttatgtgaattctcatgcaggtcttggaattcatgagcatgtcacaaagatcaaaatatagttgggaaaatgactagctagcagcatgagtcatagtctaatgtttgatggcttacatcaaagagatcatatgcaggaattcagaaacacctcatatttttctcatgttgtgatgtcttctaccagcacctactcacttactgaagaaattattgcaaagctcccccagctacctggtgtataagaaaaaaatcaaagtcacattctctttgccctgctattatattatgtcagtctacacaagtatttcagagctagacttaaaaaaattaaaatgctgtttgctaacaggagtctagctgtgagtttgttttgcagggctttgttaaatctatagaaccacacaatctgtcctgtatatatagcccttgatgtctgtgtatctcaggcagtattctttcctgggttgacttgtagcaatggtgattaaaaaaagacacaatatgttgttaaaaggaacatagcccattcaggatttatgtactgacaacatttcagcaacatgtgatacagtcaaaaatgttaaaatagcctttctatttcacaaggaaagcaaggatattagattgattctgtttccataacagtacatcttgatgctatggttttattccagctcaaccatttgtcatttttttctctctctttctcctcccctaggatggggtaggggaagggcaagtgggaaaaaaggaggggtggaagcaaacacattgggtttgagacactgaaaatttgaattagagtatcaaattagacaaaatataaggaggctgggatgttagaacttgccaacttgctaatcactgctttctttcaaggtttagttccaacaatgtaaggcactttgaaatctaaacaaggagaccttaaagaagtcatcagcaaggtcagaatgaactgatgatggggttttcattggttctctgctgtgatggcattttgctatgtgtcattgtcattatcctcccatcccaagcaggcacagaaaaaacaaagcccagagctgtactcaccagccttgatgtggacatcctgacttctaattttccctgaaggattttcagctgtgcaataataagtattatcatggattaaggtactgaagcttgaaggagggaaggggaaaatttggagagtgccgttggggtggacgtggcggatcccggggacatcgtagatctcctcgcccgtggctaggtaccatctgagagtcacaggagggatgcctgctgcggggcagggcaccagagtccccgtggtgctggcaaacactacctcttgcagagatgcattgacaaagtagaggctggagtgtaggtcttcactgaaaactgcaagaagacaacacagggatccataggtgagtaaaacatgcctttgacatttgcagttcaatgtctggcctcagaaagttatcctgaaaattaatcatgaggcgcaggctcaaataaaaccaaataattcaaattttctgaaaatgctgtgagcagacaggctgatactaaaaaataaggcaccatcctaatttcacattttgtacacaaactgttaagttatcctggatgttaatttttaatagattgtttttttgcctcatgccccaaaccctgttctctccccacactgaccaccattggactgtatatattttatattcacttattgtctatcttctgccactagagataagcctcatgaggacaaggtcttaatttactcccactattacctggagcatagagcccagctctcactggactctcagtaaagggaagctgaatgtgtgaatgcctagatcttgttgctgggatcaaattgctctctttactagcttcactgagggttattatgcaatgaaatttgccacatttttaattaaaattgcaaatcatatgtaaaacattttattttttattatactttaagttctgggatacatgtgcagaatgtgcaggtttgtcacataggtatacacgtgccgtggtggtttgctgcacccatcaacccgtcatctacattaggtatttctcctaatgctatccctcccctagttccccaaccccaacaggccccggtgtgtgatgttcccctccctgtgtccacgtgttctcattgttcaactcccacttatgagtgagaacacgcggtgtttgcttttctgttcctgtgttagtttgttgagaatgatggtttccagcttcatctacatccctgcaaaggatatgaactcatcgttttttatggctgcatagtattccatggtgtgtatgtgccacattttctttatccagtctatcattgatgggcatttgggttggttccaagtctttgctattgtgaatagtgccacaataaacatatgtgtgcatgtgtctttatagtacaataatttataatcttttgggtgtatacccagtaatgggattgctgggtcaactggtatttctggttctagatccttgaggaatctccacactgtcttccacaatggttgaactaatttacactcccaccaacagtgttaaagcgttcctatttctccacatcctctccagcatctgttgtttcctgactttttaatggtcaccattctaactggcatgagatggtatctcattgtggctttgatttgcatttctctaataccagtgatgatgagctttttttcacgtttgttggctgcataaatgtcttcttttgagaagagtctgtttatatcatttgcccactttttgatggggttttttttcttgtaaatttaagttctttgtagagtaaagcatgttaaaaaagcaccattatcagaaaatacaatgtcaaatcaacaatacacttttatttaaaataggacataacaataaagagaattttgacaaaagcatgactcaactccaccagcctacagtgtctgttttgatttttacatttcccttgtggtccacctgcctccatgccttatctatataattatatcatgttaaagtgtacatacgtaaaatgtaccatttttataactgtttaattcttttatacatcatctacattattccatggttctatacggacttcacaagtaaatatcagtgaatgcacaatttatacatattcttatgaactgtttttctgctcttttcatttaaattgtttctcttttcgcttctacaagtaaatatcatcaaatgtgttcatacacatttggctttttaattcatttaagggcctataacaagtgtttctggagtgttggttatgtgaagaaataaaacgtgacttccagaatttacaagttaaataaaagatttataaatataatgaaggcctacttgtcacacatctgagcttctccatgactttctaaagcaggtgcatacctagttacatatttgtaagagagaagagaagccccagatatttcgaatgaacttcactggtcagaagtgagaataacatttattgtatgcttcatagtatctcataccagacaaccttctaacactcgagatgaacaacagctccgctaggtaaacaaaggctccactttgcagacggtgacatggagattcacagggctgtcacttgaccaaggacacaggatacaggctgtcacttgagcaagaacgcagggctaggaggtggcagaactagattcagtctttctgatgaaggcttttgagatttttgttttctcatcttagaaccaaatgtggcataacagtcccccctcatttgtgtggggattacaggcagctctgtatagagtgggtctatggcctgtgcttccagatctagtctttctccgtggtgtggagctgaggggttacaggctcctgctatgtgctggggttgctactaagtctatgtgataaaatacatgagcccctcactttgcctgtagttaactgacatgatttggtaagaaagagatgaagaaattaacactatttacaaaggtgattggactcatcttataataataagatttaacctgctcactaaatgtgagggtagcgggtggtctccaccctgctgttaggaagcacagcatccaagcattggcacaaggctgaatagatgtggttgactctactcacagcatgttcttccctgctgccacttggtggacactgtggggctcccttcagatttcctctttagcgccaatgcaccctgccccaaagcagctggaaagatcctatgttgagtcctacactgggaaccagcccaagttacagggaactgccttgtctgaggcctgcagggaatgactggtcaaaggtggctccacaagcctggccccctcgtgttaagttgcaacaatgctgaaggtgcatcccacctgagaccgctatcatcagagctttgcagagaagcttctccctccactcattctgccttcctcacacccttgctgatgtctctcttgagaatacactcccaggaggccttctgcatgcaactcttcctctgagcatctcccttcaggtaactcaacaggagacatcaaatgaggctctgctagttaccctctacaaccatgtctttctgaaatgtttttctattttaaataaagtaatcagaaagtgccaactaacatcccatgtaagctccccaatagagcatgagcaataaataaaatacaccaagatggaagaaagtactaaatctggattatcactggattaaaacatttttacaagcaataattattacattgaataaggcaatgacacaactaagactctcaggctgttatgtttttgggaacccattgaatctggacagtgacagtgtgtagtttgttttatgaaaacatactcatgtaagaatctaacatttcaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagaatctaacatttatctattatataaacattttgatttttagttaaacttcacatattcaatgggctcatagccctaagcctaatgcctagcaagctgtgtgtgtttcgtaaatgctagttggtgcattcactgtccccatattttttcattttcccatctcataattcatgtggtatgtcaaacttctgttgataatataatgtaaccttttgaagtatttttggaatttctattttacaaaattacaactcttttaagtagattggaattacctctcacagtttaggaactgactgtatagaagttgagacagagagagagagagagagagagagaaggtggggggtacaggcgaaagcctttagcgaggtcctgatatagagagatgcttacaaactgtggccccccttccactatgaacaggaaagcctacatactgatgtgaattctgctcccctgtgagggacacacaatgtagatgtctccaaagtagatgggcccccgataagaccctctttctccttgatcaggggaagcatcaaaagctattgtcaatctgtgcgtctcaagaagtgtcttgttcaacaatgctggaaataacatggatgatctcacacttgaagacctacacctccttggggatgttggcagatgatatctacctgacaggtccactactggggtgagatctgagggtcactctggctgttaggccatatatggcaccaatgaaaactctaacttttcactggtgtcatataggatggaaatgttaccagggccaaaggcttcaattatagaaaagtttatcagtataaacacagtggtcaatgacacacaatcctgcagggcattgagacgtgtgttgtgtcacagttacattaggaaacttgctctcgtgtgcctatatggaatgtagacttctatttagtaaaaccaagaaggttaacccctaacctcactaaggagagatgggaaggattgctgtctttccttgcacaaatataccttagagtgcacatggcaaaacttcattctttaactaaggttaggaaatatatcaataaatatgttggtgtggggatgaggaagggcaagtgtaatgagattcctggcctactatagcctagaaagaaaacttcattaggaagaactgttagaaagttatgaggatggcatatggtggtcaagatttggtatggtggaatgagctcatgcattttagcactacatcttgttaagaaactaaatggtcatgtaaccagtcatttaaacactaagcaccaactttagattgtcacaataaaggaagaagtagggagcagaatagaggcagaagagacattaatctaataactagatgagctaataactaggcctgggcactctccgtggcttgctacccaagctgtctcgggacctatccgctgcattgtgacaaagtattcctcagctgccccagccatggctcaagtggtcccaggcctggcttaacttactgctctggaaggtactaatcataaactttggtggcatccatgttgtgttaattctgcaggtgcacagaatgcaaaagctgtggggcatggctttctccacctaaacttcaaagacttcccagaaagcctgcggccctgggcagagacttgttttagaggtggagccggcacaaagagtccccattagggcggtgctgagacgaattaatgggccagagctgcagcagagactgtccactagagtaatgcctagtggagccacggaagtggggctggccctgagatcccagaactgtagagctaccagcacataacatcagcctgggagagctgcagacataagactccaacccatgagagctgctgggtaaactgagcccaagagcccaacaaagccaccaaggcagcttttcctgaggccctggggacccaatccccaccccagtgttccccaggtgagggacatggaattaaaggggtttcttatccagctttaaacttaaggttgttttctctgttgggttttagatttacttgaaacctgttacctcttcctgcctctttctcctttttggaatgggaatgtccatcctgttcctgtctcaccatcgaattttggaattagatagcttgctttgattcatagctcatggctggagggaatttgcctctagatgaatcatgcctgagtctcactcatatctgattcagatgagactttggactttcaaactgatgctggaattacttaagacttttggggtactgggattcaatgaatgcattttgtatgttagaagtttcaggaggccagggcagaataccacgatttgaatgttcctgccaaaactcacgttgaaatttaatcaccagggtaatggtactgggaggtggaaactttaaaaggtgactcgtaagaggcagatccttcatgaatggattattgtcattatcacaggagtgagctccttataaaataatacattctgcctccattttctttctatcctgaacacttgcttctgtcttccatccttccacctaggatgaccttcacctgatggccttggacttctcagcctccagagccatgagccaaataaacttctgttgtttacaatttactcagtctgtgtattctgttttagtagcagaaaatgaaccaagacaacaattcacgaaagtttcactcttcacactcatacagaataggtgaaaccttttcacatcactattttagtttcattatatgcctgcctttattccggaaagtcagatctaggggaagctgtgtccatgagatttagcatcctccaggtatcttacttgaaacatccatcgtttttctcttggtctccatcactggcagaaaccaagagtttggcctccagggccagttggggctatggctaagctgggaagcacagtgaacaccaattgccaaaaggtggcagagaaaaatacattttgtacaagcgatagctcttacccacagagaagagaggcaggggtgttcatcaagtcgtaagtgttttatagttttctctcccaaccataactaaagtctttagcaatgcttcataagtcagaatatgaaaattattgctaactaagaaatcggttcagatcagaagcatagttaatagttcaacacggcagttttcaactcaaataaaaatgctgatagtagcactgtaattttacatttgagctttccaagaaactgacattaccccaaacatattgttaggaatgaggtaactgtcactcttcaaggctaattaattccaccaggattcttttattttttttccctacattatttttctatcaacccgactgtgggtaatttgaactaagcaaaatttggtcatatttgaatttatcctcttgtatcctaaaagtagtcttgttaagaatagcaagactttaaaaatgtaaatgtatacaagaaacattgcttaattaaatgtatagtttcttattgaaaatctcattccacaagccagcttgtgaaattatttaaatgactgcaggaaaaaaatgataaataaatgtttaatcctagcagttaaagagataagcgacctatgggggattactgtcacttctccttatatttttaaagaattttacattagtctttctccttcatgccacagggtttaataatgtaacataaactcattctctaagagacacatcatatggccacaggcaaaagaaaacccaaactatattccaacagcttttgtttcttccatctaagggaccatccatctgcctaaataatagcacttctttttatagagtgcctcctgctctttaatacagtaacatttgcttcctccagtaagggcagaggcaaccttaatgtgaattatgtgtgtgtgtgtgtgtgtgaaagttcctaaaaaataactgtgggttcaaaacagaaagctaaatgaaacattcagcacaatcttgtgaaattcagggttgaaaatcctggggtaccaacactaagggagctaatgggagggaccttggagaattgtttcttcagttgcagacttctcaatattttacatccctgtaacagacggcataaccaaggctccactgacaaacataaagaagagtgttacaccaaaaagaaaataaatcaatattttagcttttcttaaaattcaaacagggcagggtgaaaaggggagatgtgggaggaattttgcagtaggcagtgacacaagcattcactgatgcaataatatttattgagcacctactaggtaccaggtcttgtgtaagggcccagtaatgcaagatataacaagtcctggtactactgccaaggaaatttcagtctgaagggtactctagttcacatagtgaggtcaattataattctatttaccgaaggttgtgacagaaacattcacaaaatgcaacagaagcataagtgatagagaaactaatctgacctatgaaaaatggaaacaactttccagaggaggaaagaaaagtacattctaggcagaagtcttaaaaaatattaggacattgagttgtcccagtcaggagagaaataaaaaggtgctgggaagcaggaaattcaatgcacagctaaaagtgttgcacgattaggagagggagctacaggtttcttagattcatttatcttggaaacactcttcagcacctaccatgtatctggcactgtgccaagaccagcagacacactaataaccaaggcgtggaagggtgctgattataaagtcaagattgtaaagagtgtcaggtgccaagctaaaaagcatgcgcttagccctgcagacaataaggacaattaggcacatacccaggagaaatgaaaacatacatccacacaaaactgtgagcaaatgtttaaagcagcattatgtataatggccaatggtggaaacagcctacatgtctatcccctgaagaacaggtaagcaaaatgcggcttagccttacaatgggatatcactcagcaataaactagagtgaagaactggcacaagctacaatggggatgaccctcaattacagccacaaaaggccacatactgtatgactccattcgtatgaaatgtccagaagagggagatctgtagagacagaaagtcgactagtggcttacttatggttaggactgggtaacgggacaggataggagggtttcttttgaagtgatgaaaacctgctaaaattgattgtggtgaaggcaccttatctgtgaatatactaaaaaccactaaactgtatgctttaagtggattctttttatggtatctaaattatatttgaataaagctattttaaaaagtaggaagtcaatgaaagttttgacaatgaacaatcaatttcccaaattgaagtttgagaaagtaaacactgagtagacagggagagaagactgcaggcagaaagcctggctagactgctctgctgggagtctaggccagctgggcattggtggtgagaagggagaaaaaaggcctaattatggatatgtctgatatgatcctaccagcatcggtgggcagggatgtgggagcaaaaagagtgaagaaaataaaaaaagtcaataggaggcaaatgtaattgcttgcatacccagttgcacagttacactattacaaagagagcctacaagacagagctggttggtaaaggaaacaacatgtcagtttcactaacgtaaagagggcactgcccctgggccacccaatagcaaattggaaataggagtccaagaccctagagacatatttggcagccagggaaatttaagtctatcactgggtgagatattccaagaaaagtgttgcattagtttgttttcacactgctaataaagacatacccaagactgggcaatttacaagagaaaggtatttaattggacttacagttccacatggctagggaagccacaaaatcctggtggaaggcaaggaggagcaagtcacgtcttacatggttggcagcaggtaaagggagtgaacttgtgcaggaaaacttctaacaaccgtcagatctcgtgagacttactatcatgagaacagcacgggaatgacctgcccccacgattcaattacctcccactgggtccctcccaaaacatgtgggaattcaagatgagatttgggtgagggcacagccaaggcatatcaagtgtaaagaacaagaagagacaaaaaccagaagtaaatcctcagggatagggagtattttataaggtaggaaaatatctgacaaaagatttgtacccaaaatacataatgaactcctacacaccaatataaaaagatagtccaacaaaaatggacaaaagtgctgggtgcagtagctgatgcctgtaatcccagcacttttggaggccgaggtgtgtggctcgcttgagcccaggaattcaagatcagcctggggaacatagcaagactctctctaccaaaaattagctgggtgtggtggcatgctcctgtagtcccagctactcaggaggcaggggtaggaggatcacttgagccccagaattggaagttgcagtgagccgagatcgcaccactgcactccagcctgagcgacacagtgagaccttgtctccaaagaagaaaaacacacacacacacacacaaggtgtgaacagtcacttcacaaaggccaatatataaatggccaataagcacattaaaaagtgcttcaatgccactggtcattaagaaaaagtaaattaaaagtacagtggggtactactacacatccaccaaaataactacaatggaaaagacagaatatattgagggtcttaagaatgtggagcaacaagaccctcaaacaatgcaggtagtaatgtaaatcagtagttattgtggaaaattattagcctctactaaagggaacacatgtgtacactgtgactcaacaatttcactcctaagtatttatacaacaaaagcacatgcatatgtccatcaaaaaatacacgctggaatatctacagcagcaacacgttgtaacagtcacaaactgaaaacttaccaaatatcgatcaataataaaattgatacatcgtgatatattggcaccttgaatcactacatactgataacaatgaacaatctgcacataaaatattataaatcacacaactataatggtgaagaaaagcaaaaagacaccaaagggatttacactgtattgttccatttatatcaaacatcaaaataggaaaaactaatctatgatgttgagagtcagaataaagtttgcccgtgggggtggggtcaggtgcagagaatggaaagggccatgaggtggcatccaaggtgcaggctatgttctttttcttgatctgggtgctgggcacactgcatgtgtacacagtgatttgcatgtatgtaacatttcaattaaaaaattaaaagagtttaaagaaattggaaaaaaatcatgaaggagataaataggaaattaggagatcagtagctcaaaccctagagagtgatgtcttagaaacaaaaagacattttgagacgttaaccaacagttttcaacactgtcaattgcttcagagaggtcagaaaacatgagaactaaaacaggctatcgaatttgcaaattgggtacattaattttgaatggaaatgccatttgggttcaagttagctttattgatttcataggaatacgtgagtgggtatgcttactaaaatgaactgcttgtgtaaaggtcttccaaaatgaaagggaatataacttagccttaggtaaacatatctagaaagcataacatttagctgattctgagactccaaaatggttttttctttggataaatgcttagaaattcagtgtcatctcgatcagacaatcacaaatcagttaaatgatgggcttataatgacttggaaagcattccaaggcttctatgaagtgattccaagtcaggttattaaaatgtgctcatatgttatagcaattttgcctttaacgttaatatatttcactcattctatctactcccaagctgtgaaatgatgttgcaactgtcatcacttagaaatatgaaattctgtctctgtccatcataaaacaacaaacaaaaacacagaaacaagaactggatttactctatgtcttcactaaagtttcagacagtacagaaaaaaaaaaaatgaaagaaggaaacaaacaaagtggaccttatgagtggcccagcttacttcctgagtttctaagataattccaaaaggaggaaatttgaataaaacttggttatattgtggggttagggggaccaagtatgacacttgaggggactaaggctgctagaatttacaaagtggaaagaaggaagttatatagagagggagctccagagagcggaaggagcttccagttgatgagtccttaactgtgtgctgatatttgcatgcgtgtaagaaaactaccaaggttggattaggaacaccagaaagaagtgggtgaaaatctgtgaagctcacacaggggagaaaatagttcatgtttcaaccagcaaaagaggtaagaacttctaataaatagaacatcagattgagtattcagaaatgtatcacacagctgcaggggacaaattaatcataacaaaatttaaaagtgatcctagaagggaacaaactgagtctaagtaattgaactgcacaacaaaaaactttgatgataattaatagaaaccaacaatcaatcaataatataaaatttacaatgtctgtcattcaataaaaaattggacacaataagggaaatatggcatattattaggagtaaactattccacagaaagacacataaatgagagatgatacaatttgcaagcatggatattaacatcactcttataaatattctgtcaatatgtacaagacagtaggaaaaaggaagagctcattgatgagagaaatggagaaaatacaaacagccaagctgcaaataaaacagtcaaatggaccttctagagattcaaaatgtaatatatgaaatgaaagttagacaaataggattaatggcagattacacccttcagaagaaactgtcaatgaaccagaaaacagagcaattaaaactacccaaattgaaaaacaaactttaaaaaggcttaaaaacagtaaacacaaaactggtgagatgtgggccaatatcgtttggcctaatatacgtataattggagttctaggatgaaaatgagatacagaaaaaaaatcgaacaattaatatacagaagtttcaaactttaatgaacactagaacctcaactatccatcaaattcaacaaacaccaaacagaagcatgtagaaaaccacaacatgacacatgattaaattgttcaaatccaacataaagaaaaaaacttaaaggcaaccagattaaaaaataaatacatgttatatttagagaaacaaagataagaatgacagcagacttctcatcagaaacaacgcaaaacagaagacaaggggagagaaatttgaagcatttttttaaaaaaaagacaggaaagaaaaactgtcaacctaaagctctatatgcagaaaaattttcataaagacaaaataactttctagacattccaaagctgagaattcattgtcagtagactagcaatacaaaaatcgttaaaatctttcaggaagaaaagaaataatatcagatgcaaatttgtgacttcataaagaaatgaagagtgacaaaaatgttaagcatgtgggtgaatataaaatcatattttctcactttaaatcatcaaaagatacattactgttaaggcaataataatgcattgtgtggtttgtaacatatagataaaatgaataacaatattaacacaaaggcaggaggaaggaggaaataaaaatttattgttgtaaggtccttctataaattaagtggtattatttgaaagtaagccatgttactttgaagatggacattgtaaactctaaaagcaaccacttacaaagcaaaataaaaacaaaacttacatgttaatcctttaatgcaggtaaaattgacaatttaaaaaatactccattaatccaaaagaaggcaagaaagagaaaaataaaggaacagaggacagatagaaaaaatagggagcaattagcaagatgataggtttaaacgaaaccaaattgaccatcacattaaatataaattgcctaaacactcttaaaagtaaaacattgtcagattgaataaaaaataaatacctaactatacgctatccaggagaaattctattataaagaaactgatagaccaaaagtaaaaaaaatagaaaaaatataagctaacactactctaaagaaagtgggagtgattatattaatatcaaagtagattttagaataagaaatattactagggacagatggttattccctaatgataaagtggtcaattcatcaaggtgacataacaatcctaaatgtctatgtacctaataaaagagcttcagaggacatgaagcaaatctgctggaattaaagtgaaaaatataaaatccaaaaggagaactgagagctgggtctctctcgctctttttttttttttttagtgctaattaccattagggtaacgtaacagtgttttttgttgagatgtaggttgcattcttgaatgttggaggttaagaaactgtgagtagaaaaaatccaatgtcatctcacagctgtcatacactagggtctggccacgctggtctcctcagtgtcctaggtccccaatccccttccaactcggggtctgtgctggtactaggctcttagctggaacacttcaccctcctttatccaattaactcctactcattcattgaatgtcagctaaacaccaattccttagaatttattcccggtcttctacctttcatactagacaccgtgtcctacctttcagcttcttgcatcacactgtcatcaatgttttcatagctattttgcatgtgcaccccactccattgcaatctagaagaggggcagcatgcttcataggagatgatgcaatcttattcttagaggcagctggtgtgctggctaatacataatagaagccctcacattttttattgaatgcataaataaatgtttaaaagaaaaatattatggttttcatactacatataactaaagagattccttttaagaagtaacaatctgtattttatatacatcatctactataatctaaattccattatatagatatcaagggaccacaaggatgagtggctgacaaaaagaatttctgaggtgctataagaacacacttcgaagattttagctactttgtgtaagaatgttctttttatccaatatttgtacttattttgcaacaagaaggaaaaagcctgatttttgccatgggttttacaaagctctggagaaaaaaagtaaaaataaattagtgttttacccagaaaatgtctgagtattgtttgcaatccatttctagagtactacttccatatgtgtatagggaattcattttagagataaaagtctctccatccctttggatggattaaagtcactctcattaacattgctaggggttaagtgtacattttcagagaggaatatagaatctgtaatgaataatatgtatgtggtttactacgttccggcatttacattttaagctcaaaggtttcaaaaggcatgaaagtggctagcgatttggaaggagcagaagacccagtgagcattatgatcacaggcagtaaagcacatgaataaaccaaaatgatgtaaatggctccttaggattcggaagcataaaaactggggaacaagaatagaacaaacgaatgaagaaagagtacagagttatgtaaagaattacaaatgaagaaaatcagcagaaataacagagaaataaagataacatcacaataatgttaacagaattgctttctgcagattaagaggcaaagagttggagagagagggaaaaaattacaaaattgaatgtccaaaaacatggcaatgtgaaatagcaacaaaaaaacagtgaagcaacaataaagtaagattatcaaagggaaggggaggaggacgttaaccaaagccaactgaatcatttctcctatgattaaagaagaaaatgaattataaccagagactgactggtacctcagcataaaaatgtaaaatccaagttcggtaattaaacctttcactccagcattaagtgaaaacactgaagtgaaatgacaaaaagacataaattcttcttagtttcattgactaatacactgttgagcattattttcttttgctagaacttcactatgttcagaagtgcttcatttttcattttgctctgacctaaggacttacagaaatctaatgttttaagtaatttctttcttcatgtaacgcacaggtttaagtttcagaaacaaaataaatgaccattctcataaatgcaaatacaccctaagtcatgagtgatgacaatttttaaaaaaactttgaaagactctttaaggattgactccagtctaatctggtccctcgaatttaccagcctttccagggtttgctctgaatgagagactggctcactggcttcctctagtatgacttcttttggctttctccacaatgttaaatccattgccattggcatctcatgactgccagcatctcatctctcttcccctttgtccttagagtgtttgtaaatccctttatttccatgttaatgaagcttctgtggcaggatgaggaagcaatgacaaagtgtagatgtccagttgccttttcttatcagcaatgcctactgtcgccaaagcagtgatggaaaaaaaaacctgcgtccgggctccaggtatgaggtactcttctatcttcccagaggacattggggaatactgcatgaatgaaactcacctgactttaccatcccttgtactcataccacctgatccagttctgtatttttgcccttgcatatcaacagactgttcgtatatgtgactttattcattgccaaaacatttgtaccttgaatgcagcaaagggggcattgtcatccttgtaaaccgtgtgctcacacagcactgagtgtatggacaatgcaatcaacacttaaatgtaaccgaaggcagacctctgtggaggtggaaaaagcatttctttgtgagaaaaggtgccatcatttctggggttctctgtagttggaacctgctctcaggttctgacctaggagtgtggagaccaagggcctgccttttctggacctcagtgtgcagccatttataaagcaaggtgtgactgacctagaattccatactcaaagtatcaaacaagtaaacgaggacaattttagatcatgcaaagtcaaaattttgacctctcatgtacccttcttcaaaaagcaattaaaaaatgaattaaaaggttgcaaactcagaaagaacatacgatatccagaaaacagacggtacaacataggtgagaaacaaaaagaatttccagaataactgtgaacgataacagaacaacaaacatacagcagaaatcagtccagattaaagcagaaagaaggctcctggagagatgtttccaggaaaaaaataaacattcaagcacgctaatgcatctgaatgtattaagaagagtgtttagtccgttggagaatttggggaatgaattagtaacacatgcagtgaaaactaagtaaacaaagaagcaagtgattattaatcctaggaaaaacacaaagctgtaatagaaaaagtgttcatcatatactatgtggctcagctgtagctaatatttacatagtcataataatgtaaatcataaatattgatctaaccccaaatggtagtatcattatatagataaaatagaaaaagataagaaaagagggcattcacagtccataaaatcaaggtaaatccatatctaaacttgaaagattaagaatttcagtgtaaaaagataacttaaaaatatgggtctgaacatagaagagtcagctttaacaggaaaaaaaaaaatactcacagaaagcaaagtctgtaagtgagtgtgtttccagagagtttgtctaattccaatcatgatcagaaggagcccaaaccaaccctatgcggaacagtgccttccaagtggacgcagcacaatttgtctgattctctgctatggtttgaatgtttgcccccactcgaactcatgttgaaatttaatccccaatgtggcagtattgaggggtagagcctttaagaggttattgggtcatgtaggctctgccctcatgaatagatcaatccatgaatggattgatggagtaatggattaattgattagtgggtgggttgtcatggaagtgggactggtgactttataagaagaggaggagagatctgagctggcatacccagccccctcttctctgagtccccatcagcaaaaagaccctcaccaaatgtggcccttcaaccttggacttcttagcctccataattggaggaaatcaatatatcatttctctataataccagtgtcaggcattctgttacaaacaacaaaaaacaaaataagacattctcacctacatcagtcagctggagactaatgacgccccacaggctctcaatgatggaaaacacacgatgctgaaatctcgcctacagaggcttatttaggagtctcaaacacgcaagactttaaaaaatctgttgattggaaccctggttaaattattgtcctaatttccttgtccacttagctatgcccctgttctgggatccagtattcttaaaacttcaagaagttttcttgccttcctcctcatgtatgtgattcttctgcacatttgttagtacttcagaaaaaaattaataagagtcacataaggtatactcaaaaatatccttaaaatatgagagttttaatcgaagaagtaaaaagcatcattcttaacagttgcccaacccaaacatgtgggtgcttgtagaggtccctgttttcctcatatcttatattcacagcatcaataagtctcttagctgtaccctcaaaatataccctgcatctgccttgtgccatctcctctgccactccctggtccaatccaccatcacctctccctggtgcccaatgggtctctctgcttctaccctggtcccctacacacacactctcatccatcagctccatcagtgagagtgatccagttaagatggctcaggccatctctggcctctgttctgagcttttgaggaccccattctccaggtaaaagcctatcttcctacaggatccatcctcactgtttcttctctgatgtcatctcctaccaccctcccctggggatcccaccgcagccacactggcctccttgtcgtctctagaccacccctgcaggctcccacctctgggtctctgtacctgctctccctccacctgggatgtttttctcccagaaactccctggctcaccttttccagccttggctgtgccgtctccccctcagggatgcttcccctgactgcctggtaaagatggcggcacttccactactgcagcgccccctccgacccacgcctgcacttactccccatggccctcagcgtctttagtgcactcgatcatttacctatttgttatacttgcttcaactgtctgcctctaaacctatcctaaaattttggtccctaaaaagtaaatattttggttgattttattccctgatgtattcccaattcctacaatagtttctagcatgtagcaaagagtctcaacaaatatttaatacttcttgaacacaagactgttaggctaaattcaattaaatatcaataagtctcagtgacatatagtgttttaaaattaaacattcactataaatgattcttttttttttttattttgagacaacttttgctcttgttgcccaggctggagggcagtggtgcaatcttgactcactgcaacctccgtctcccgggttcaagcaaatctcctgcctcagcctcctgagtagctgggattacaggcacctacaaccacgcccggctaattttttgtatttttagtagagacggggttttatcatgttggccaggctggtctcgaactcctgacctcaggtgatccacctgcctcagcctcccaaagtgctgggattacaggcatgagccaccatgcctagcccactacaaatgattctgaatgccgcctctccatttgcacagcaccttaggcccttcccaagcattttcacccatcattgtcacatttaatcctatagatgtttattcttacagactgcactaggtgagaagtcagagctctagagaagagaaggaaattagttaccctggattccgtattgtgtgtcagcaaagcaccaagatgcccaagtgtgctccttcactcagtggtaatgcatctacacgtggcaatatttcaatctccactgacatgggtcgctagccccgtgtctgccaagaaaatatcaccaagtgcattatcaaactttatattcaaagctgtaactattgcttctgttcttggcatgattaaataattagcttttatggaatacacattatgtgctaggattatgctaagtaatctaaatacaaaaccttattttaatcctcaaactacacctcacaggctgctattgctgctatttttatgtcagagatgagaaaccatataaactttgaactctgtcgtgaggaacagagctgggatttggtgctaggttgtcagttaagcagtgactgtgtttgggctcagaaccctttaagaatgagaagaaagtgctgcactctgtcatgaacaaaaaggacacacacagttctgtttccagctccttaaaggtccaaatccccacttaaaacacctttgatctaaacattgctgcagattatttaaaattctcataataagatgtgcttgggctaggtatgccgtgtagtccttggagctcatctaaagccttataaactgaatcgtgttcctttgtaatcacttaacatttagatagattgaggttcagtaatcagatctttaagtcacagccacacaaaaacaagacaactctgctaacatgtctttggttataacatttatttcctgtttctttttttgttgtgttctataaaatcttaatgacctactttcatatacttcttccagaattaaaactatgatcaaaaattgaaaaaaccaaaccagaaaacatgatttttagagtggcttcctccaaagacatcctctaggccagatccatggtgaaaatgtagcacattcaacatacactgtggtattaatgctaatttacaactgcactacaaccaaatctcagttggaattcattaattttgacagtttgcctatcacactagaatgaattcgccgagtcacagaaacgtctctgaaaagagaagaatcacattctccttgctattaagtattcataacagactggagttgaacattctcaaggcaactagacataccattaataatcccagaacctatgaaatgtggcttgggcttcaccgagcagaaacccgtagccactcaggtctctttccttctatacctaatatgcaccagctgtgtaatgggctccgaagagcctccggggcgcaggaggtcataaaatagagtccattattccacattggaaatttgacttgatttggacttgacacttcatttggagaaatgtcctggaggcataattttttctggaagtttggggttggggtgagtggctggctgttgcaaatgaatcctgtggaacatttttaaacttaaaggaatgagacttcttaaatatttccttcatgatgacttctcaaaataaaattgagttgtaaagtctgaaagttattactggaatgttttaaattaaaccgacccaggatcgcagatttccaagagagagtgtgaagaccgtgccagtcacagcattttccaccgtttgataaaaatcaaatcttatctgtaaagacataactgttctaagattttataagcagaaaataacgcccatagcatctatcaaggatgccccagggccacaagcctggcacgctgtccagcccatgatgctgtctctataagaggccacctgatgtgatgtgctggaagactgttgccaaggcaacacaaactgcaagagaggagggggtgggagcaagaccccggactcacaataccccagatttcaaatcagtagatttagagtatttgcatattttggggcacctagagtacaatgttaacaatatagcacatgcaacttgctcaatgattactaaagcccaaaacagaaattgttacaaaatattatggaatgatcctgttaccatcagaaaaatgtttagcccatagaaagtaaacctatgaccccaagtcactacctaaagacctatttttatgtttgcatatttggaccaactctatgcatttaaaaacaaaataatttacatatttattgtttctctcatacttttaaagtatgaggccagtaaactagaatgtcagaggcaacaaatatgagcttcggtaaggaaggtttggtaataaggatgtgagccataagcatgactgttctgaagaagtatttaggaatgggtcaaagtcaaccttacagattctgaagtaacacaaaattaggctagtattaactttgttgtatttaatgttttcattagtcacttaaacacaggtagtatgataggagtgatagtgagaataatgttaacaagaagacaatttcactaaataccaggacagacactgcatgatctcatggaattccccatcaacccacaaggcagttgcaatcatggtcctcatgataaggaggggaaagttgaggctatagctcatggggcggtgagtatactagtttgctagggcttctgtaacaaaataccataagccaggtggcttaaacaacagaaatattttttttcatggttctggaggttagaagttcaagtttgcagtatccacagggttggtttgttctgaggcttctctccttggtttgtagaaagtgtcttctcaatgtatgttcacattcccctttgtgtgtgtgtcctaatttcctcttcttataaggatatcagtcatatttaatgaaggcccatcttacaggccacattttaacttaattacctccttcccactgcacccccccccccgccccccgggtgagagtcttgctctttcacccaggctggagtgcaatggtgcgatctcagctcactgcaacctctgcctcccgggttcaagtgattctcctgcctcagcctcctgagcagatgggattacaggtgtgcaccacatctggctaattttttgtatttttagtagagacagggttttatcacgttggcccggctggtctcaaactcctgacctcatgatccacctgctttggcctcctaaagtgctgggattacaggcaggagccaccacaccaggcctgcttaattacctctttaaaagccccatctccacatacaatcaccttctgaggtcagtggttaaggcttcaacatagtttttgggggataccattcaacccctaacagagggaaacaaggatggtagaggaaccagggaccataatatgggacaaatgtgatagaattctgaagattctgcaatgactgctgtgggcaggaggatgaaatctattatatcaccctaggaccctcccttcctttaagaatgaagttaaagagaggcagatgccaccaccatgtaaggcagaacattctaacaattagaactgcccaacattgaacatactgaaatgttttcaaggagaatggtgtattggagatgccaagaaccttgaaggttgactcagcaatatctagtctcttactcattccaattaagagtcatgaaatcacaagaagaatgcatgtttctctgccttagaggagatacactgattcaataacttcatctccttggaggctccttgcctgactgatgtggacaaggtcctctaattaatcacacattagctctgattcctaaaatagctcatacaattattgaggcaatttcaagtgagcatgctttgcaaaataagttacttttgcccctatactagtcctaattagctacttgtatcataaaactagaaaagtctagcctgaatccaagacaaatgcatacaaatgatgaatatgaaacactttttgagaggacttaaaatgtgaagaaagcaatatatgtgactattatcaccatttaatggtactttgtgcgagtcctgggcttggagccagcaccacggatatgatgatcacttgctattttttctactatttcagagtctctgcttttctatgctgggtaagatccatgtgattggcaggtcagacgatgcataaagtgatttgaggcaattacagcgacagttaaagattaatatgggaaaatactctcatctatttttttcttcctgtatctgagaaactttctctaaaatcattaccttcctgacctatacaaaagaggccccaggtatggcaaactgtgccaggcactgggagggtgcagacatgcatgcaggtgctggaggggcaaaaggccaggtagttgctgcactcgtaaataacccactggagaggcacttacagggaggcaggctggagacaagtgccaggggaggtatgaaccaggagcttggaaagaacagaggagcctgctggatactgactgatgggactgaggaggttgctgcctgcagtttcttttgcggtttcaattccctactcccagtctactttttggtgagacctcacattggagaagcggaattactccactgggggtaattttgccctccctagggaaaattagcaatgtttggagatactgttgattgtcatgagggagggtttggggagtgctatgccatctaatgagtagaggccagggatgtggccaaacatcccactgtgtgtgggacagtccctcccattgaagaaccatccaacccaaaatgtcaataggccgctgctgagaaaccttgcctctgagcatggcacccatagactgtgggtcctgctctccctctggcccatgagtgacttatcagagaggtgagtttgggaagagaaagtgacacgcctccttttcttctcccctctagcctccttgacctcaggggccatgcccactgctctgctctgctccactctccccatgttaagttgcagcaagaccctgcttgtggttgggggaagggctccaggggcctggcttggtttggttctggggtttaggattagcaaggccattgctgccacccgtcagcaccacattgtcaagctcagactttgtcataaacagatgatatttgatctccacctgacccctctctatatctttctgttaattgattccaaatataggcagggagctggggtgtcttggcatccgtaaaccccgacatcacttactgttgaatcttaaacagatgatgggccctaacttaattatacaaatgtcagtccttaataaatgataagcagagtaagccctgtgaggattaacttagatgtgcattagatgcgatgtggggtcatctagaaatcggagtcaccccaagaaacgctaaatgttgtcaaaagatgacactgagagtctccaatccaaggaaattttcacctgaagctttccactttaacagcatctacagagatcaagctacggggctacaagaggagagcaggaggaagataagaaaaggggcacgctgcttcctcttcccaaacccatctctcagataagtcactcatgggccagagggagagaaggacccacagcacatgggtgccatgcttggatgcagggagccttgaaaaatacttttaaaaatattcaagagccaccttgagaaaggcctctttaagagacaaaggggccagagcttagagtcaagccatgcatacacaaaggacagaaaggtcttccatccaacctgtgtaaatcactgcactttcttctatcagggtgagcctcaatctgcttcttcgaatgtaaatccaattgtcggagaggtctacagataatgtttaccaagcagcctcttaggaaaaattcaactgggacctccatcccaccattccagccagagtttcaatatggctcgttcacacttgatttccacacccttcttttcagttaatacccttttttccttctaatgttgtatgaaaatgtagactctgagggttgttttcctgcttgtttaatacgtgcagtctctaccgtccctcagctttgtcagtccaccttcttgggttctgaatgttctcatgtatttatgtagacaaacgtgaatgtgcttttggaagagaagagagtagacaaagtaagaagagaatcttggattttgacttgttattgtcacaaaacagaaatgctggttggttcaatatttaaactggtcaactattcacaaatgaatttttaaaaaattgctaaagcattgagagataaattagcaaaggaattcattactctctgttctctttgcctgtacatatatgttatttgcatgtatcacactgagggtactgatccacgtgtttttctcctccagttgatttaaagttccaaatgggtaagtactgcatcctattatgcttgcatttctaacacctagtacggcactgatacaagctagatgactatttgtgtttactgaattaaattccattcaaaagatacatgagcaggcaagtagcaaggaggaaatacaactagttaaggaacgtatacaatttacagcaattaaggaactgttacaaactgccacagtgtttaaaacacacttgctttcatctgaaatgagtgtgtgcatgttttagaaagcaagttggctataggtgtcaagatcccaaaaaaaggctgcaaactcttgcccagtatttccacttttgggggcctattttgtaatacaaatatttaccatttgtgcagtacccacctacattccagacacactgtgctaagagatttgaaatgtcattgcatcctttagccctcaaagaacaaccaccagcaccttatagggtagagattagtcctattttaagaaggaggacagatattaactaatgtatgaaagatcacaaaggccacatggctagaaagtgacagagtcatgattcaaacccaaatctgttgcattctgcactattttttatttacagcatttctgataccaaatgggcagacttttttctcacaccaaccaattctctctggaagagcaaatgcatatcctacatttcagatcagttctgacactcactacccagaggtagtgcagacttccccacccccagcttaagggctccattccccgagattgccctcacttctgatgccaggtgcaagtagctcatccccaggctacccacacttcagtccaacttgaatacaaagtcaaggggaacctatgaatctcccctttcagttttcataatttgctagaactgctcacaaaactcaggaaatcactttacttagtattatcagtttcaaataaaggatgtaactcagaaatagccaaatgtgaggagagatgcatagggcaaggtatggggaaagggacacagagcccctactccctccctggacgcatcaccctctcttcactcaaggatatttacccacccaggagctctcctctgaagcccatcatttagggggctttctggtggttctattacataggcttgattgatgacatcattggccattggtaactgaactcaacttccagctcctcttctctctccaaaagtcagggggtaagctcatgggggccgtgggtatattagtttgctagggctgtaacgaaatatcacaggctgggcagctcaaacaacagaaatgtatcttgtcatggttctggaggttagaagttcaagatcacagtatccacagggttgatttcttctgaggcttccccaattgtgaccaaccctgtcactgtgacttggtctttttggtgtgcagccccccatcctgaaggtatctagggcctccaaccacctcattagaacaaaagaggcttccttcacacttgtcattcaggacatctcaagggttttaggagctcctgtgtcaagaaccagggacaaagaccaaatatctttctatgatgtcacagattgtcaagcccaagcttctttcttctataacatatactgaagttacaatcttaaatagcatagggttttttttgcaccaagttattctttttaattttacttaaaaacccttatagaattgaaaattatataactactccacaagaagaagatagtttattgtggaactttagttttatggaatattatggatcaaaaattacatttaaaaagaccgtgaaacactatagaaaatacttaagataaaatgttaagcagaaagcaaaattacagtcacacagtgatttcaatcagaaagcaagttgatgctacggaacaaatactgtaaggaagattctagaattatgggagttaggacaatagacaatattttcctttattctaatttcttatttttactaatggattgctttactagtgaatttcttgaattctgactcttggttataaaataaaaggcaggctttaatttcactgtaaggcagaaatgatacatattataggatcacaagtgtatatatataaaaaatagagacacacagctttataaggaaatacatcaacattttacccagttactggagaggtttgcttttaaaaactcagcaaccggccggacagtggctcacgcctgtaatgccagcattttaggaggccgaagcaggtggatcacctgaggtcaggagtttgataccagcctggccaacatggtgaatccccatctctactaaaaaaaatacaaaaattagctgggcatagtggcaggtgcctataatcccagctactcgggaggctgaggcaggagaatcacttgaaccaagggggcaaaggttgcagtgagccgagattgcaccacttaactccagcctaggcaaaagagcaaaactccatctcaaaaacactcagcaacctgtctgggttcatgtgtcatgactatcaggtgattatagggctgatgacactaagccacagggagaggaacacaatctccgcaggcagaaagagcatctcattctctgctggctttccagagcctggccacatccagcatccagctgacctcagaaggggctcttgagtgggttctgggctcccagtcttccagcccatatcaaggtgaggtgcagccttacctcctgtcatgcagaaaccaccttctttttctgaaggcacagtcaataaaatgatcctcccattcaagtctccctttctgaccacactttagtctgagaggtagctctcatttcaggggagtgatagccttcaagggatgctgtggctcctactagtgggaggcatatgtttcattcatgtgaaatgcatttcacgacagtcttggcaaagagaagggtctgctctgttatgtaccccctccccgtaagtagcaatagttgattgtatttgcttgatattttacatcagaagaacaattagtttcttgcttttgagaggttaccaaataaggttttaaaaattttaccaagaaactaaattaaattaaaatgcacaacaggttgcaggtagaccatgccaatgcatgaaattctaactcttgctcttttcctaaagcaaacagtgggaaagagttgcatcagggacccagagctggttctgtaaccacttaattgtaatcgcatcttcttctgcccttcattaaggacaatcctaactgttgtaacaaataaaccccagaatttcagtggtccaagctaacaggcatttacatcttgcttaggagtcacatgaaggtcaccccagtagtgttcatgattggtgggtgcccttcctctacacaacaattcaggaaccttggttcttgccttttggagacctctcatgtcctctatcccagtgtttttcaaagtggaggtcaattagaatcacctagagtgattgttcaaagacagattgcggggccccaccccagagaatctgattcagtaggtcaggaatgggccccaggttttgcgcatctcacaaatcatcgagtgacgttgatgctgccagtcaggggaccacacttggagaagcaaagtcctagaaccagatagcagagaatgcagagaaacacacttcctgcttcactaccaaggcttggaaggtgcatcacttcaactcgccatccctcagcaggggcgagtcacacggacaatccccaacaaggagagggatggaaaccacagcctgtgtctgggcagctgcttcccagctccaaccctgcaggaagaagggggagcatgagttctggtggggagtgcaccatttctgctagcgtccagtgatgcttttacagagctggctgtccttcccatggatcatcatgttccttttctccagattttaatgtggtattatttgtactgagactaaaggagaggattatagtcttatcttgtcaccattcttaatttcagccataggcaaagaggaaagaacaaggacaaccaaacctagacaggcgacaagaggacaatggcaggagcactgtctgcagcaatgctggggggaggtgggggccatgcccttgaggagtcggacagagaaatccacctgctcagggaaggggcagccccagagaggctggtccagcaaaaggatgtattctttgacaacaactttcttgttgctggggctgccataacaaagcactacagatgagtggcttaaacaactgaaatttagttctcacagtcctagatgctagaagtccaggaccaagttgtctgcaggattggctcttcctggggcctctctctttcctgtgtcttcacagggctatccctctgtgtgagtctttgtcctaatctcctcttcttataaggatgccagtcagactgcattagagccaaacttaatgacattattttaacttcatcacctcgttaaagactctatctccaaatccagtcacatcccgaggtactgggggttaggaattcaacatataatttttttaaaagtacagtttggcccataaccctggggataaactgtagttttaacttcccgaaatcagttaaaacttagagaattagtttttttttttttttcccccagaaaagaaattatctcctgattctggcaggcagttcagtgtcagtggcttctttcactttacagtttccagaaatgattttcaatattcagtccatcatcacaagtggaaatgtccattgggaaaggccacctctagatgatgcaggtgtaattttttttttttttttttttttttttttttttgccaacatttaaaccaagagctacagcaaacccttgctaactcctcacctgggaacatgtgacaacacctgtatgtgggcagaggaaatgcctggagctgacaaccctttaaagcaactgctagaaagcgcctaagacagtgctctgtaaattttgacacaaataaaatgtacaactcctttgaggataaaaaactctaaatttaatacagaagtcttcttcgagatttgaaatgtgaagtttcaaatacagttagctttgagccgtgccaatccaagcatggcaggttttactgcagccactttgcaaagctaaggggagatgaggagatagtttggccagaatattaaagccatatattcagtccctgccagacaaactaacggcagcccaggtaaagagggcagagaattgtccacagcatttgctgaccccatgtgcctcctcccccaatatgtttcccacacattagagccattgggaataaaaagctcttctttaaaattcaaaacttccatggagcatcaagccttatttacatttgagtgcaaattactttaatcatataattttcagcatttgttgagtgctgctgtgtatttcaagaatgtacaatttcattttggataaagtgaatggaagggaagtttaggatccatctggaaggagtcaaggtctttgacccaagtaaggcaggctaacaaccataggctttgaggtggtagacacactggggctgagaggaggactcagaaggacagggaggatggcaagtgtgaagtgactactttgaaatgcctggaggcactgagataagtggcacagttctgaaatatatctgctgtgatttacaaaggttttagtggaagtaacagaagttgataatgatgctaagctcagaagatctcagattggtattatcctccaactctaggttaggcagcttatagtctctcaaactgattgacaatatcttagctaggtaactactgtgtggcatgcagaaggacaaaggctgttacacttactcagaatttagtgggggcataggaataagatgagaacaccaaggccctcttatggaagattaacctgaagtcagtgcagaaaaagtgactggaaatggagaaagaggatgaacacaaaatagtgagagtggtctctggttttctaaagcatgagactctgacatgctgaaaagatcaagtctagcttgggcaatgatttacttccttggttttctagtttttcagctaaaaaactgacacttaaaaatgtctacagtgaaatgctgttggacagaagggatacaattatatatttaaaatggacaaatgggtgcttaatatctttcatattcacatgttaataaaacatgtgaatgcacatgcatgcactcttccagaatcactctaccaactgttttccacctatgcacactaaaggaacttatcttctctgctgtcttcctgaatagcagttctcaaaccatggttccccataccaacaacatcagccttacctgagtgattactagaaatgcaatatctcagcccccaaactcagagtgacagagtaagaaaagtcacctgtgtgtttaacaagtccactgggtaaatttaatgcatgaagtctgagaaccactcttccagactagcaggttctagctacctggctgcacggtagattcacctggatacttcttagaaaagcagtaatactgcagccccatccagatgaaataaatcagaatgtctgtcaataggatctgggctgagatttttattttttaaaatttccaccaggtgattcgaatgagcagctcagtatactgacctgagtaactccagatgaggtgttacttagtgttcttgtattgactattcctatatgttcattccttcatttccttaaatgagaatttctactgtatgccaagaactgcagtaggtgctgagaatacaagatagatagagatcacacatttctagagtttttagtctggtgggcatcagaaaaagcccaccacgtacagccacacaagttgtgcactggccaacttcaatgggcacccttcgtatctttatgtacaacctagacagtcacatgcgacatctgaggttgaagtccaaggtaaccttggcattttaagatggagaatatataattccaagcagctttagcctttgtcactggtactgccaaatcctgaacaggaggtcccagcagaactaaggacagtgaattgatttctgattacttcactatgcagctcatttcccaatttctttttctggtagctcattattggtgtagctcatagacatgcaactaatttttgtatgttgatttttgtatcctgcaactttaatgaatttgtttaaagatggagaaaggggtcaggagccaaggaatatgaggagcaccactgtagggctggagaagccaagggaatgggttctcttctacagactctgaaaggacatggtcctactgacacactgattttcatccagtgaaagtgattttgtacttctgtccttcagagttgcaagagaataaatgtatgttgttttaagccactacgtttgtgataatttgtgacagcagcaatataaaactgatacatatacacaaataaagaaaatccagaaaacagagtagaggtttgagaaagcagttaagggcagctgaaatttaatgatctccctttagtgggccagggtctgtgctggttactttgaatggattacgtcctatccttacaacagttgtttgagattgtcatcatcatcaccagattcattgttactgttattgccatcttcactgtcatgatcatcattgccattattgtcaatatcatcatcatccttttaattaacattttcatcattatttttattttaaagatgaggaaatacaattatcaaaaaagttaagcagtatcccctaaattacccacctggcaagcggtagtcagagtttgaatgcctctgtctcaaaagtacaatttccaaaaggtacttttcactaaacaaatttatacttacacttactttactgaagaagacttctgcattgagatataacattccactctaattggagctcagaagactttcatttcatgatctttatggcctgaatacagagtggctgaatcaaccactttgaagagctacagaacagattttattgacggcaactagcaaaaagcagtacatcccacaaatgaatgcagcagtgctcccacagacatggttcatatagaaattcacatggtaaaataccactaatagactccccattcaataccatcttgcccaaaataaattgtttctgcatcatcaactcctggcaacaactttgctatatctgagttgtcatttctcacaataatggccttttattccacttggggcctgtcacctggaacaaataaggtctttacaaggtcccagaaaatgagaaaatgttctccataaattatatttttctgagcttattccccactctgacataatacaagaggttaacctgctagagatgtcgaatttcacaccccaaaacatgcagtgaggatctgcttatactagaagaaaaaaacaatcaaatgtatattttaaaaaattaaaatttgagataaagaagtacatttaaaaaaaaattttgtgatacaagagagttattctgataccatgtttctgtctggtcaacagttctcaggatctttcacaagtccttgatctgaggaattctccctatcatttctcaaaatttttctttgttctcatgatgtaaataggtcaaaatttcttataatcaaatctgctgaccaatagatctaaatacaattctataaaaagtaacagtaattatgaaggagaaacatgagcaagattgcagaatagaagacaccctgacattatttcctccacaaacatacaactggaaactattaaaagacaagaataccaccatgaattcaccagaacttggggagaagtggagaaacccactaggccataataactaagaaaaatggtcatttcagactgtgccactctcttctccaggcttgtataatgccactcacagagaattgacacagactcatggtttctaaggtgggaagatggaattggaggtggatgtttgatccccctaccagtatgggaatcttcatgggaagcccactcaggtctcactgcacaggaacccctgggagagctaggagggctgaactacctggggtgaactggggacaaaaagtgggggtgctgatcacttggtgctggaatcttggagctccaatcagcagggatgcagatgtcatactgaggagaccggccagcactatagtgctgcaggaagcatgatcggcaggaaggtctgaatctctggccagacttcccacaaagctcaggtgctcatgtggagtcttcccctgacctggaaacaactgagtttggaaattaagttcctttggaaattaagttccagtacgtatttaagtctttcccagaccaggaaacaatagtagagtagcaatttagttctagtccagtgtttaagttccagtgctcactataagtgttccctagactgggaaacaatggcagggcagtgattaagtcccaatatcaagtagtagaggtccaacactaataacaccagcagaagctggaagagtggctttctcttcaaatatgcaggcatcatcataaaacacgcaaaaattgtttaaaaaaaacaaaacaacaacaaaaacaatctcagggaaatatgatgccaccaaaagaaacaaacaaaactccaataatggacccagaagaattaaatatctatcaaatgtctgagaaagaattcagaataatcctctttaatttcagggagtcacaagaaaatgtggatggaaaatgcagtgaaattttgaaagaatttgagaaatttagcaagtaaatagaaacactttttaaaaatccaaatagaaatcctaagaataaagaatacaataactgaacttattgaaatttatgaaaagcttattcgaaatcttcaatagcagacttaaagaacccacaacctcaaagacagaacatataaaattacccaatcagaggagaaaaatctttaaaaaaagattgaagaaggcctatgagaattatgagatactatcaggcaaactaacctctatataatagtagttccccaggagataaaagagaaaaagttctagaaagcatgtttaaggaaataatcgctaagatattcctaaatctggagaaaaaggacagtatccaagtataaaaagctcagagatcaccaatcaaattcaacccaaagagaaattaaccaaggcacagcatcaaattatcaaaaagcaaagataaagaagaaatactcaaagcagcaagagaaagaaaacatatcacattcacctgagccccagtgcaagtttcagcagatttctcaacagatacactgcaggccagaagagattgggatgatatattcaaagtgctgaagggaaagaaccttgtagccaagaatagttcacatggaaaatgtatccttcaaacacaatggagagataaagactttcccagacaaggaaaagctgaggaaattcatcaacatcagatctgtcttacaagaaatgctgacaagagttcttcatctgaaagaaaagggtgctaatttgtaacaagaaaagatctaacggtataaaattcactggtaaaagtaagaatacagacaaatttagaatactataatattgtaattgtggaacgtaaaccacttggatcttaagtatgaagactaaagaaacaattattaaagatagtaattacaacaattagttaagagttaatataaaaagatgtaaattgaaacatcaaaaataaaaatgaacgtgtgtgggatggtgttaaatgtagtttgtttttcttgctttaatttgcagtcaaagttaagttgttaatcagtttaagataacttgttttaactataacatgattttaagcatcatggtatttacaaagcaaaaacttataatagatacactaaaaataatgagcatgaaatcaaaacatactactagaaaaaaaaaatctctcaaggaaaacaataagagatgaaacaaggtagaaaggatctataaaacaaccagaaaacaagtaacaaaatggtagtagtaaagccccacctaacaataataaccttaaatgcaaatgaattaaaatctccaattaagagacatagagtgactgaatggatttttaaaaatgcccaattatatgctgtctacaagagatctttcacctataaaaacatgcacagactaaagagatggaaaaaagatattccaaacaaattgaagcaaaaaaaaaaagcaggaataacaatatttatatcagataaaatagactttaggtcaagaatggtaaaaaataaacaaaaagaccatgatataatgacaaagggatcaatacagaaagagaacattacaattgtaaatatgtatgcacccaaaactgggactctcaatatttgagaccctcaaatatgtaaggaaaacattaatagatctgaaaggtctgtagattgactataatacaataagagtagggaactttaatacccctactttcagcaatggaaaggttatccagacagaaaaccaacaaagagacgttggatttaaacagccttctagatcaaatgaatccaacagacatttacagaactttccacccaatagattcagaatacacatttttctcaacaagacatgatattttctccaggatagattatgaaagtcacaaaacaagtcttagaaattttttaaaaatcaaaatcatatgtgtcttttctgaccaccatggaataaaactaaaaatcaataacagaagaaatgttcaaaactgtaaaacttcatggaaattaagcaacacgctcctgagcaacagaggagttagtgaagaaatcaaaaataaaatttaaaaatttctcgatcaaatgaaaatatgcacacaacataccaaaacctatgggatatagtaaaagcagttctaagagggaattttactgtgataaatgcctacatccaaaatgtagagagatctcaaataaaaaatccaatgtcacaactcaagaaattagaaaagaaggacaaactgaaccccaaattagaaggggaaaaataacaaaaatcagagcagaaataaacaaaatagaggttttaaaaacaatacaaaagatcaagaaaacaaggaggtatttttgtttaaataaaaaaaaaacaacaaaccttaagctagactaaggaaaaagagaaaggactcaaataaataaaatcagggatgaaaaaggaaacattaaaactgatactacaaaaatttaaaggaccataagagcctattgtaaatttctatatgccaagaaattggaaaatctagaagaaatgagtaaattttggacagacacaacctagcaagattaaatcatgaagaaatagaaaatcttaatagaccaataatgaataaccatattgaggcagtactaaagaatctcccattcaaaaaactcccaagacttaatggtatcactgataaattctaccaaacatttaaagaagatttacaactaatctttctcacaagaattctaccaattcttccaaaaaattgacaaggagggaacacttccaaactcattctatgaggccagcattaccctgatccaaaaatcagaaaagaatacaacaacaaaaaaggaagctataggccaatattcctgatgaatacagatgcaaaaaatcctcaagaaaatagtaccaaactgaattcaataatatattaaaaagataattcaccatgatcaagtgggattcatcacagagatgcaagaatgattcaacatacacaaatcaataaacataatattaccacattaacagaatcaaggccaaatccatatgataatttcaatagatgctgaaaaaaatttgataaaattcaattccttcataaaaatcctccagaaattggttataaaaacaacacaccttaatttaataaaggccatatatgacaaatccacagagaacatcatactgagcaggaaacagttgaaaacttcatttctaagatgtagaacaagacaaaaatgcccacattcaccacttttgttcaacatagcactgaagattctgtccagagtaattaggcaagggaaagaaagaaaaggcatccaaattaagaaaagagggagtcaaattttccctgtttgcagacaatatcatcataattagatagatggttagagaaaagcctaaagactccatcaaaaaaaaaatattagaactaataaatgaatttggtaaaggtgtaggatataaaattaacatataaaaatcagtagtgtttgctatatgccaatagcaaactatttgaaattgaaattgaaaaagtaattccatgtacaatagttacaaggtataaataaaatgcctataaataaacttaaccaaggaggtgaaaaatccctacaatgaaaactataaaacgccaatgaaagaaatcgaagaggacacaaaaaattagaaagatattccatgttcatggactgaaataatgtttaaaaatatacatattatccaaagtgatctacagatttaatgcaatctctataataaaaatctcaatgacattcttcactgcaatagaaataacaatcctaaaattcatatggaaatgcaaaagatcctggagagctaaaggaatcttcagcaaaaagaacaaagcttcaggcatcactctacctgatgaaaatatactgcatagctatagtaaccaaaacaggatgacactggcgtaaaaacagatacattgatgaatgtgacaaaatacagaacctagaaataaatatatgtatgtatatccaaatgatttttaacaaaggcaccagaagtactcattggggaaaggacagtatcctcaataaacggtcctcggaaactggatatccacatgcagaagaatgtaactagatcactatctccatattcaaaaatcaactcaaataagatcagaggcttaagtgttaggaccataactatgaaactactagaagaaaacatagaggaaatgcttcatggaatggagcaaggattctttaaagacaacctcaaaagcacagacaacaagagcaaaaatagacaaatggaattatatcaaattaaaaatcttttgcacagcaaaggaaataacagattgaagagacaacttacagaatggggaaaaaaaactatttgtgcactatgcatctgacaagggattaatatccataatatataaggaactcaaacaactcaatatcaaaaaagcaaataattaaatttaaaaatggacaaaagatctgaatagatatttttcaaaggaagacatacaaatggccaacagctatatgaaaaaatgctcaacatcactaatcatcagggaaatgcaaatcaaaaccacaatgagatatcccttcaccttagaatggttatcatcaaaaacacacaaaaaatttaacaaatgctggtgaggatgtggagaaaagagagctcttccacgctgttggtgagaatgtaaataagtatagccattatggaaagaggcatgaaagatcctcaaaaatttaaaaatagaaatagcatatgagccagcagtcccattactggatatagatctaaaggaaatgaaatcagtgtgttgaagggatgtctgtactccatgtttactgcagcgctgttcacagaagctgagagatggaactgacttaaatgtgcacctacagaggaatgtataaagggcggcctgtaactgtctgaaaccttgttatttctcccacgtagcctctcccctctaatccttcattggctccactttcttcttctttttttttttccttttttgagacatgttacccaggctggagtgcagtggtgtgatctcagctcactggatcctctacctcctgggttcaagtgattctcctgcctcagcctcctgagtagctgcgattacaggtgcccgccaccacacccagctaatttttatatatttagcagagatggagtttcaccatgttggccaggctggtctcaaactcccaacctgaggtgatccacccatctcagcctcccaatgtgctgggattacaggcatgagccaccatgcctgacctcattggctccactttctccctcagcctcctagtctctcattttaagctggcttttgtcccctccactccactgaacatgctcttgcagtcaccagtggcctgtgttttgctgtagcagtgataattgacactattgatcatgcatggtttccctctgataggaattttcttgctgctttttctaagtctctgttgctggttcctacttcctgatttctacgttttgaaggatcccagaacacagtctctggactttctttctttcccagtctctttgtactcactccctttctccctttgatctcacccgttctgaaggtttttagtatcatctccaggctggcagcaacaaaatttccatgtctgatccagacctcttatctaaactccaaacttctacacccaactgcctgctcacatctgcaccaggatgttgaatttgcatcagaaaccgaacattctttttactgagcccctgatcttccttccctgccctgtttccctcactcgatgagcagtccctctgccattctaactgctcaggctacagtccttgatttctcactttttctgtcacctcaaatccaacctatcagaaaatcctacactcagcctttgtgatgcacccagcacgctgctcctttccccatgtccacaccatctctcgttagaatgactaaaatgactcccacctggagccctcgctccagtccccatgccccttcagctctatgctcaacacaatagccagataaatcttgttaaagcataagtcatataatgccaccctgttcaaaaacctccaacatcctctctgtccctatctccccttcctgtccctcccttgctaaccctgctcttgtcacacaggctgctgcaggccttggtgtttgctgtttgctctgcctgaaaagccctcttccacccccgctgacatccccaggactctatcacttcgtttaggtttcactcaagtgccccttctcagcgagaccgactctagcctatctgaaactccacgtctcccttaaaattactcttcttcactgcttcagtttctttgcactaattacaatctactagtctacatattcatttatctgatgcattgctctcccacacccactagaataaagctaccttaagatgaaggcttccgcctgttttgttcacactgtatccccagcagccagaaaccatgtgtggcactcagtatttgcctccaaaatttatttgttgaataaatgaacaaactacacacatcaccatggataaatctcaaagcaataatgtggagaacaaagctagtcccagaagaactcttcctctgtgattctaattacataaagttcaagagcatgcacatcttagcaaaatattacttaaggctacaaacatgtggtacaactacaaagaacattgaggattagttaacaaggagttcaggagaggggttcctactgtagggtggggtggggacgtgattggagaggagcacacaggggccttttcaaggacacttttctatttcttaagtggggttctattcatgtttatattttgtgtaaaaaaaattaagttacatttttaaaagacaaaaaaagacaaagttacatttaaaaaatcattgaagcaagcagagtgcatcacctccttgtaatccaatattcataatataaatgaccccatccccatctcctcggccactgatctgatgcctctgttctgcttatctgctgcattaccagctcactgtgcagcaaattcacactattcattgttagctctatagcccaactggatggcaaacatcccaatagacaaaactccaagaagagtcaaaacaagaataaagtgcaggtcatcttttcttttgcactcctgacagcactttgtacatggtaataataatctaccaattaactacataagccacatggttttattatagtgtgaagctttgtatccagaaaggagagaaggctccctaagactctgtcaagaatgggtgcttcctttctgctgtaacctcttcttttctccaaagccagctcacctcttcctcctgactgagcacagctggggccctcccctaggtcggcttaatgaggtggggccctccctctggcttggaatccacacacattcctgcagccaaatgctgcagcaagaggcagggaccacgtttaatgcttttccttgggaaactgacctgtgtctccactaatatctgacaatttggcaagaggaccaacaagatttgaggcaatatgtgataaaatatgcagttatttaaaaaaatacttttatagattgggtgcagggacttgtgtttgtaatcctagatactgagaaggctgaggcgagaggagcacctgagcccaggagtttgaggtcacagggagccatgattacatcactgtactccagcctgggcatcggagaaagaccctgtccaacagaacaacaacaacacaaatagtgttccaaaactggataagaatgcagatgttcaaaggaagccctgaaaataagctcaattttaaaaagcggggagtaaagaattacaaaaggaaggaaaggaggagagaaggggagaagagggaagcaaggaggaaaggcaagtgttttgttcactagtatatccccagaaacgtttaaataatagacactaagcatttgttgaatgaatgaagtaatagatgaaatagatgtgaagcaatgggagaaaatatggacttacatggctaacaccctgtcacgtggcctgcacctgaatctacacaacaggcccctcagcctccaccatgtaacagagttcagggagcccagcctttttcttctaacacctcaatgccagacttgctccatgttggacaccagcttatctgtgcttctggtaccccagaggtacttgatgaacatactattttatttatttaacacatttggagagagtatctgcaaggattcctccaatgtagtatatcagggggtattccttggtctgttagttcccagaaaatgacctcattctatggaaaatctggttgtccatggttagtccaatgtggtgacacaaaatggaaatccttaaaactaaagaaagaattacagtcatttaataaagacaatgaaactgaaacatcatgaatcatagtttaggaaatcaatttgtaatgaagaaacatttagtatgggagaagggagtgagtaaattacctacggaaagatgaagcaacacatttatacaaagtgtcaatagataaaatggacacacctttagatgtatattatactgattttaaaccacacacattggtaacaaatagactaatccatttccaaactaattggattgctgggtgcacattactatcagagtagccagaggtaggcttcaaactaatggtagtaattgcttttaaacaacctttagatgagtccaggcatcttaaatgtcctatttatctccctttcctattgtagaaattatgctacagatcagcctaatgggggacccacacctaatagacatacaaaggacaattagaagagtcgagaagtaaaaagcaaaaaatgaagttttatagaacgaatgaagacaaaaatctgaaccgcacctgaagtggagctgggccttgtcacgaacaaaaacttacagtgcaaggttctgcagctggctggctttatgaccttgagcttccacttaacctgtccacacttccagttttcatctacaaattgaagggggttgtgcaagcatttgacattctttcagttgctatgggcagtgaacctatgaacatgacagtgacagcaatggcaagaaacagccgtgaggtcttcttgccatcaggccagagcctcttttcttgctcagactccgctgtggggagcaaccgcacaccagaccctccgacacatcctccgtgtttctgccagctctgccactattcaagttctcctgattttatcagcacctgctcttgttctcccatgcccaggaccactataatagcctcctttctattttctgctaatcatcactcccctaaaacacacaacaggtgcaatacttttgacatattaaatgtgtctaccttcagaatcccccagaaggagactctgtgacagggattcaagcaaaagtagtttatgtgaggtagttggtttcaggaaacacaggcaggaaaggaggcaagtgaacaataaaaggaagacggtcaatgaagggcacattatagcaagtcgccactatgagaaatggcagcttcatctcttggagacactgagaaccagagcaggaccctgcctcagttactcttcctgaaagcctagctagctgaggtttacatcaccacctccggctgtcactggccgtggctgctctcaggagtcaatctcaggcactttcacctgccaaagagagtccttaggggaagtgttgctactgggcagctggaagtgctgccaggaaatggtaaggaggtgacaggctccaggcaggcaccaacagcacctgcaacaccaccgctcatttttgtttcttaattgtcctgtgtctccttcacacacggagttgatggcagccattgcttcaaagaaagatacagcctaaaataaagactcagggttttgctctgagtttctgatttgtttctcaagtctatggtaagcatttcatttgaaagtctggatttataggacaattgagagggaagagagttttctaaattcccaaagcctccttctgcattaaggcagaacaaagcttggaggtctaatgatggagttttgccacaagacatggtgtgaagacttagaatatggctcaggacagagttcccacaacatggaagaggaagggagatgatgcagtgggcaggacatggagagatttgggggataaggatgaggttaagatgttgcctagggtccagttacggtggctcatgcctgtaatcccagcactttgggaggcagaggtgggcggatcatgaggtcaggagttcaaggccagcctggccaacatggtgaaacactgtctctactaaaaatacaaaaattagctgggcgtggtggtgcatgcctataatcccagctacttagaaggctgaggcagtagaattgcttgaacccgggaggcagagtttgcagtgagctgagatcatgtcattgcatttcagcctgggtgacataaaaaggctctgtccccacctgctaaaaaataaataaaaaataaaaaagtttttaaaaagatgttgcctggattcttgagaggaatcttagatttgagggtgggtatggtttagatgatagaaactctggattggtaggagtggagaaaaggaaagggaaggtctcccctaccctgagaggccacagcagagtgaaaatgctgcaataaaaagataaggcagagagcaggactgaggtagcaccctggccccccaaggtataggcgagttgtgtaggggattccaaagtttactgatgtgaatttaagagcaaaatgagatgctcatacatcttgaaatgagatattcatatagcttctatggcagactatttgcaaaaaatggctgcaataaattctgtcatccttcatgcatgtcctttgcaatgtgactttgctgctcccctgacttctctactcctagaatctggtgttcgccatgcaactggctttagttacaggaatattggcagatctgatgcaagaagttgggaattaaattaaaacagatagcacttatttagtaattgctttatgcatgtcactgtatgatacggtttggatatgtggccctgccaaaaacttatgttgaaatgtcatttccaatgttgaaggtggggtctggtgggaggtgactgaatcatgggggtggatttctcatgaatggtttagtgccatcctcctggtactgtcacgataatgagtgagttcttgtgagatctggttatttgaaagtttgtggcacctcccccctctcttcctcccgctctggccataggagctgcctgctccctctttgccttctgccatgattctaagcttcctgcagcctccccagaagctgagcagatgccagtattatgcttcttgtacagcctacagaacagtgagccaattaaacctcttttctttataaattactcagtctctttttttttgtttgagttagagttttgctctgtcaccctagctggagtgcattggcatgatctcggttcattgcaatctctgcctcccaggttcaagtgattgtcctgcctcagcctcccaagtagctgggattacaggctcctgccacaatgcccagctaatttttgtatttttagcacagatggggtttcatcatgttggtcaggctggtcttgagtttctgacctcaagtgatccacccatctcggcctcccaaagtgctgggattacaggcatgagccaccacgcgcagcccaggcatttctttatggcaatgcaagaatagacaaatacactgtactaaacacttcatattttaacttcttttatcctacaactcacagccataggagggaggtattattattcttgttttataaatgaggaagctgaggcacagaaaggttggtcaaaggccatacagtttgcacatcttagaggtagtattgcaagccagacgatataactcccaagtctgtgcgatttatctctggaatatttacaattcagcctgtaagaaagattgcccaacaaatggtcgtgtgtgtgtgtgtgtgtgtgtgtgtatgtgtgtgtattttatttttatttttattttatttttttgagatggagtcttgctctgttgcccaggctggagtgcagtggcatgatctcggctcactgcaagctccacctccggggttcacaccattctcctgcttagcctcccaagtagctgggactacaggtgcccaccaccaagcccggctaattttttttgtatttttagtagagacggggtttcaccatgttagccaagatggtctcgatctcctgacctcgtgatccacccgtctcggcctcccaaagtgctgggattacaggcgtaagccatcgtgcccagcccatgtgtatatattgttactcttccacatatataaaaggtcatgtcactcagcttctatggtagactatttgcaaaaaatggctgcaacaaattctctcattcctcatgcatgtcctgtgcaacgtgacttggctgctcccctgacttctctactccttcaatctggagttggccatgcaacttgctttagtcacaggaatattgccagatgtgatgcaagcagttgggaagggcatgagcattgtggcttcctgggacatgggtccaccacccgagtactaggctaggctagtccaccagagggtaaagagcatgtgctgaggcccagttgtgcctgccatccgatttgaagcccagacacttaagagaatcaagagagtgcctctccttactagaagagctgcacagctgcccccacagaatcatgagaaatcataaatgtttgccactttgggccactaagttttggcatcaagtctcgattgaatcctccctatgtgtggagtactgtttcatgtgggggaatacacgtatatccatcacagtggacagaatcgtgtccccctaaaaggtaagttcaagtcctaacacccagtacccgtggatgtgaccttatttggaaataagaactttgtagatgtcatcaaattaagatgaggtcatactggattacaatgatctctaattcaatgactggttttcttataagaagaggaaaatctggacaaagacccagagaggcagacacagacccacagggagaacacggtatgatagatatgacaacagggactgagaaggcagccaccagcagccacagagagaggcgaagcagactcccaccaggagcttcagagggagaccaccgtgctcacaccttgactttagacttctggcctctagaactatggcaaaataaattcctcctgttttaggccacccaatgtgtggcactttgttacggctgtcctaggacattagtgtatattctgagagatgcagaaaaagggactgggaaaaaaataaagaggaacacagaataaagacctaaaactgtggcaggcgcctgtagtcccagctacttgggaggctgaggcaggagaatggcgtgaacccgggagacggagcttgcagtgagccgaggtggtgccactgcactccagcctgggcgacagagcaagactctgtctcaaaaaaaaaaaaaaaaagacctaaaactgagatacagaggacaggaggtgtggtgactgctggcataaagtggaaagaatttagttacatgattttcttattttggggggtctatttatggttttcctttgaacccctcaggccaactccggttttgtcatcagctgcttgcttaggcgaggatgaggggggcagcttggtttcttggggaagctgggggctaacctggctcctaaaagggcctctagcccaaaacttcacaccccaaatggtcttgtcttcctcccagtcatgacacacttggttcaagagaaatgggattctttagtgggcctgatgaagaccctcatgccctgacagatgatacatagtagcatcttaaagatgttaaggatgacttttgatttttagccctttatctgacccacaaccatttattcttgttaatagatcatcataaataaagaacgcaagtatgcttgtgacaatccttagagtacagggatccggactgcacaaggctgcctggaaggggtgtgaaatggggtagtgaggaggcacaaaaaggagagggagagaagggtagagagaagggacacatagctcctcccagcctggggcctttgctcttagtcccatcctgtctcatctcttggcattgagtctcccagtccatccaagaggattccaggttggattccacagtccccaggctctcagcctcccacgtgctccaagcctatcctgagtgcccatctcactcccaccactctccatgaccccatgcatcaggactcctccttgcccccacattctccaagcatcatggtcacctaatagccggctctgctttgaattcctcattgcccctggaatcttttcaggctggattacatctttttaagcctgaataaaaaaaccaactgaatgatctttaaagtgcacgtgactcgcttgtgcccttctgatcatggataaatacccatatccctgggggcagcctgccagctggcctgcctatctctctgtcccccagtcaaggtgcacctgcaggctaattatgcacatcaatacggcggggagtgggctgtccagactcttctgtgctgccctcagttgggttgattgctggggctggcctcggagcacttgctacgggagcatgagaaccattctggcttcagtccaggacttcaaagccagctccccatccctcctgccatcatcccatgagcctgcccctggcagcagtcattgcacagcctggggtgccagtctttgcttccctccttttccttcctcactgccgccttctatctccatcactgtcccagatgaaaatgcagccatcgccctccacacatcaaaagggggaggtgacgagaggggcattcatctttttgcctccatgaagaatcaggagctgtattggatacgtttacatttatttatttatttatttatttatttatttatttatttatttatttatttatgagacagagtcttgctctgcaaccaggctggaatgcagtggcaggatcttggctcactgcaacctccaccccccaggttcaagcaactcttcagcctcagcctcccgagtagctgggactacaggtgcatgccaccacacccagctaatttttgaaattttttttcatttttattgtttttagtagagagagacggggtttcaccacgttggccaggattgtctcaatctcttgacctcatgatctgcccaccatggcctcccaaagtgctgggattaaaggcaggagccactacgcccagccacattcacatttattgattcaattggcccttgcttcacagctgcttcaaatatttcagaattcctcctgttttttacatcatgaaactgaggctgagagggtgacgttagcttgcacaggagccacaggtcatactgagtggaatttgtgtttgattctgacctgccttaccctagagacactgtctttctatccaactgcagaggtcctgggcacaggccagtcagggagtaagaatgggccatttaacaagcattcatagccaccagcagtcactgctttgccagtttcaagcaggcaagagtcaaggaagcctcagcagctgtggcattttgccacccaggtagaggaaccttgctttcctgcaaatctctcctcctgtgatccttgactgatgcctggcttggctgtgctgtttttctgggaagttagatgttattctcatgccatatctctggctacagctcatggactgtgcctggcctccagaatcttcccctttctgcacctggcaccaagccttctaatacatccctaccttcccagctgggacagggtccccaagacacctcactgagaatcaacacgatcagtccccatagtgtgtgcatgtgacactggggagcctggagctgatgcacttacttataatcacaacattcccaaagcacaacttggagtttggctctttgccttccttcttctggaatgcaacagtcattgttgaatttctaccctcacctaaccaggcaattccttatggaaagagtcagtctggtatctgaactcagtgaatgacttcaagttaaacccaaggctgcatccatgatccttccaagtagtggactttatcatccttgagtctggctcatcacgaagatgcagttttgctaaatctaagtacagctcttatctgctccaagtctcccagctcggtacctgttatcaaatgtttttaggagagagtctgtttccttatcttttctagcttctagaatctacatgtatttcctggctcatggccccccctctattttcaaagccaacaacatagcatctctctctctctccctcccgccctccctctttttttctctcctccacccctccatctctcatcttatatttgaacacagatgtgtactacagggagaacatcatgtgatcatgaatacagacatccaccagctaaggagagaggactggaacagatctttccctcacagctctcagaaaaaaaacaaccctgttgacaccttcatcttggacttggagcctacagaactgcaagacagagcaaacttctcttgttcaagcctctcagtttgtgatgctttcttaacagccctaacaaactaatacagagagaaacgatcccaattagagagtgccctggtacgtttacttttttaaaaaagaacttatcagaagagtactttcagggatcatttctatagttcattactagagaagtttctctaaacatgtagagcatcaaaaccgcacaactacatgcaaactgaacaacctgctcctgaatgactactgggtaaataacaaaattaaggcagaaataaccaagttctttgaaacccatgagaacaaagatacagtgtaccagaatatctggaacacagctaaggcagtgtttacagggaaatgtatagcactaaatgcctacatcagaaagtgggaaagaagtaaaatcaacaccctaacatcacagttaaagaaactagagaagcaagagcaaacgaattcaaaacctagcagaagacaagaaataactaagatcagagcagaactgaaggagttagacacatgaaaacaccttcaaaaaattaatgaatccaggagctggttttttgaaaagattaacaaaatagatagaccactagatagactaataaagaagaaaagagaggagaatcaaatagacacaataaaaaaatgataaaggggatatcaccactgatcccacagaaatacaaactaccataagagaatactataaacacctctacacacataaactagaaagtctagaagaaatggacaaattcctggacacatacaccctcccaagactaaacaaggaagaagatgaatccctgaatagaccaataacaagttctgaaattgaggcagtaaatcaatagtctaccaaccaaaaaagcccaggaccagacggattcacagccaaattctaccagaggtacaaagaggagctgatactgttccttctgaaattatttcaaacaatagaaaaaaagggactcctccctaactcattttatgaggccagcatcatcctgattccaaaacctggcagagacacaacaagaaaagaaaatttcaggccgatatccctgatgaacatcgatgcaaaaatcctcagtaaaatactggcaaaccgaatccagcagcacatcaaaaagcttatccaccatgatcaagtcagcttcatccctgggatgcaaggcagattcaacatacacaaatcaataaacagaaccaatgacaaaaaatacatgattatctcaacagatgcagaaaaggactgataaaattcaaaacaccttcatgctaaaaactctcaataaactaggtcttgatggaacatatctcaaaataataagagctgtttatgacaaacccatagccaatatcatactgaatgggcaaaagctggaagcgttccctttgaaaactggcacaagacaaggatgccctctctcaccactgctattcaacatagcattggaagttctggccagagcaatcaagcaagagaaataaataaagggcattcaaataggaagagaggaagtcagattgtctctgtgtgcagacgacatgattgtatatttagaaaaccccatcatctcagccctaaaactccttaagctgataaacaacttcaacaaagtctcaggatacaaaatcaatgtgtaaaaatcacaagcactcctatacaccaataatagacaagcagagaactaaatcatgagtgaactcccattcacaattgctacaaagagaataaaatacctggaattacaacttacaagggatgcgataagacctcttcaaggagaactacaaaccactgctcaaagaaaaaagaggggacacaaacaaatggaaaaacattccatgctcatggataggaagaatcaatattatgaaaatggcaatactgcccaaaataatttatagattaaatgctattctcatcaagctaacattgactttcttcacagaactagagaaaactactttaaatttcatacggaatcaaaaaagagcctgtgtagccaagacaactctaaacaaaaagaacaaagctggaggcatcatgctacctgccttcaaaatatactacaagtctaccataaccaaaacagcatggttctggtatcaaaacagatatatagaccaatggaacagaacagaggcctcagaaataacagcacacatctacaaccatctgatctttggaaaacgtgacaagaacaagcaatggggaaaggattccctatttaataaatggtgctgggaaaactggctagccatatgcagaaaactgaaactggactccttccttaaaccttatataaaaattaactcaagatggattaaagacttacatgtaaaacctaaaaccataaaaaccctaaaagaaaacctaggcaatatcattcaggacattggcatgggcaaagacttcatgagtaaaacaccaaaagcaatggcaacaaaagccaaaattgacaaatggaatctaattaactaaagagcttcagctcagcaaaagaaactattatcagagtgaacaggcaacctacagaatgggagaaattttttgcaatctacccatccgacaaagggctaatatccaggatctacagggaacttaaacaaatttacaagaaaaaaacaaacaactccatcaaaaagtgggtcaagtatattagcagacacttctcaaaagaagatatttatgccgccaaaaaaaaaaaaaaatgaaaaaaagctcatcatcactggtcattagagaaatgcaaatcaaaatcacaatgagataccatctcaagccagttagaatggtgatcattaagaagtctggaaacaacagacgctggtgaggatgcagagaaataggaacactttcacactgttggtgggagtgtaaattagttcaaccattatggaagacagtgtggcgattcctcaaggatctagaaccagaaacaccatttgacccagcaatcccattactgggtatatacccaaaggattagaaatcattctactataaagacacatgcacatgtatgtttattgctgcattatttacaatagcaaagacttggaaccaacccaaatacccatcaatgatagactggataaagaaaatatggcacatatacaccatggaatactatgcagccataaaaatgaatgagttcatgtcctttgcaaggtcatggatgaagctggaaaccatcatcctcagcaaactaacacaggaacagaaaaccaaacaccacatgttctcactcacaagtgggagttgaacaatgagaacacaggggcacagagaggggaacatcacacaccggggcctgtcagggggtggagggcaaggagagggagagcattaggaaaaatgcccaatgcatgcagggcttaaaaccgagatgggttgataggtgcagcaaaccaccatggcacatgtgtacctatgtaacaaacctgcacattctgcacatgtatcacagaaaaaaaaaaaaagaacttgtcagaaagttctgtggaaccaaaagtacttactataattgttggtttggagaggcagaggaagtaggagagggtgctgagggcatactttcctaaccaatgtcattgccatgaagatttctgaggtctctggctccttcttccatgcccaattccttgcgcagagcaacttggaggcaaatcatgaaggcactgcctggcccagcccctggccctggaggaggcacttcctcctcctcctctgcttccgtggggccttttggtctccatcatgtcagacttagcacttcctccagctcagcatctaacgtgggtgatttgcacctttattatgaattgtttattctctggggtatctatgaccacagtgtgcaagtgatatttccattcaaggaccaaagaaaaaaaatttttttaaactttgtttcctgagagacacattccaggcatcatagaagcaatgggggagggatggggacacagagagtcattgcaggtaggctatgaccccgggaagaacatccttcacacctggtaacatttgtgagaaggtgtttcctccagaaaaaattagttcagggacattttgctagtaagaggccaattatctgtttgaggccaccaacagaatggttgtttaatttctataaccaaagctgacgtctcattgcatgatcagcgatcagtgcctgttatcaacagccgcaaagggtcttactctagggctccgatgcccgctccagatcccctgaattctcatctcacatgtggctggtcagctgcaggagaacgaggagctgacctccgccctgtgctgctgatgggaatggcatttccccaccctgtgcagctctggcagcctccctcttacccctgctatcacagccgcggaggcaggcagggagctcgtgacagctggcaagccagcctctgggaataaaacattttagcacttcataaatttctaacaaggtttcaaattgcggccgtttccctcctctcagctccgtcaactagcaaaaggggttgggggtgggggaagaaagactaattaaatctacggtgggaaagcactgctggtaagattgctacttattaaaaatcatgaactgttaggacccgattacaaagtaagttgaaattctccccattttccccatacataaaaatataaaacagagcctttcaattttatatgtatttggtatgtgtgtatatatatatatattttcaaaggattaaatacatatccttaacaggatagctgatatatgacattcttaaacctaagggaagatgacacataactaactaaaatgctgagagacattcaatatcaatactgaacattaacattgaggcttggtatcatttacaaagtagttatttcacattcttttcccctgggagttttactgaaagaaaatgcttgctagaagagcatcagatggagaaaacacagcctggaaagcctcacccaactgacagcttccaagttccaagttttggtcaccatcactaatgtttttaaaaagacaaaacaacaattccaaaaaaaaaaaaaaaaaaacaactttttttttttttttgaggcagggtctctttctgttgttcagtctggagtgcagtggtgcaatctcagctcactgcaacctccgcctcccaggttcaagtgattctcctgcctcagcttcccaagtagctggaattacaggtgcatgccaccatgcctaatttttatatttttagtaaagacggggtttcaccatgttggccaggctgatctcgaactcctgacctcaggtgatccacccgccttggcctcccaaagtggtgggattacaggcatgagccaccgtgtccagccaaaaaacctttcttaatttcatggttctttgttttaaaagaagggtacttgctttacaggaaatacgtaagccttatgggtaggggaaatgtggaacagggaacaaaaaaactaattcacaaagacgtttaattgtcaactaaaacatgttaggagcactgtgggaggggtgtgtttggaaaaataaggggtaagattttaaatagtttcactctgagaaaaccagcattccttttcctactagagtaagtaagcagggttgccttcttcaggtagtgggtctcacatgaaaaaatttcaatctgaaataagggtcgtagaattggtgacgtgagaattgggcaaaactagggcacagacagatcctggcagtaacttcgggcccacatcactttgggcaaaacacacagacaagcacgaagcaggtacaggacaaccaccagctgctgcactgagcattctctgcgctccctgcaccttcgcctgatgcccattttcttttttagcgtgagaaagttgacctttaggatgacatacaaaataagcttctccagctaggatgggaggcaaaatgcaaagaccatgtgtgctatttatgtttgagaatgaaccttcctgcaaagtatcagcctgtcgtatatttagaacagagaccccagggtgggagcatctcatggcagctcccaattgaatgccagatgcaaatgatcacttgctattaatcccagccttgctaacatttggtcctgagcatcacagctaattgacgggatgaattaccatttctacggatggtgccacctgtgacattcaggatctttgagaggtagaacccgcagtagtttaacattgccagtttagtcagttatgatcattgatacatggctcaccattttctctctttctctctctccctgtgtgtgtgtgcgtgtgtgcatgttacatggtttcactatgagatatacagcattttattttgtctacatatgcaaatgttcagtgacagggacaaaaagaaaaaaaatcaagaataatgaatgtgattaagtggaaaactacttataaaacactctaaagttgactaatataggcaaacactgttaaagtcgattttagggaatcatccaggtatttcacatagcataggctataacttcattaaagaaaacatggtcacccctgcctgaactgcacccagattgcaccccagtggctctgagccaggacaggtggccagtcaccccctgcctgaattgcacccagatggcaccccagtggctctgagccaagacaggtggccttcccacctgcctcattaccttacggtgacacccctccccccacccccaccctgaggggctgcagtgtgataattctgggaagagcttcagaacctatctgtcctgcatgctaatccaagtttccaagtgattttatgtgcattttctcatccagtgctcccaacaattacagcttgtctttcactaaccgaaagcattcttctctatccctcccagtaattcctgcagggcataacctgtgaggaaaagattagagatggctaatattttgggtataatgaacgaagccagcttcagtttattttcattaaacacaattcccatttccaggtgtttgttagttttggtgaacatcacaggatggcctttccccggtaagtgcagcaatccatctgttgtaaggagcacctctgcactcagacctcctgatgtggaagtgcttcaaggtaaaagcaggcttcccaaagcttgcgttgattgtaattgtagtgaaagttagaaacaaaagccagtagttactgagaacagaagttgagcaccagacctcggatatagcataggggtatggaagatcttatagaacaagaggaaaaaacaaggcattttctttgaaaaggaaggtggaggcccaattgagacaggctgaaattcacccaagaggggagattatcaaagagatgcatattgaagacgtcctttgatgtcagggtgaagtagtatggtgactaaaatattagaactatctctagagggcagctggggatgtctgctcctattaatccactagagtctagacctgaaaggctcatgggggcccttccccaaccctctgctctcacttcccaaggctataagtggccatgatctgtgctgaatccccactgcagggaacattccagaacaaggattgacacttacatctctgtgatacactacttgttctctcatattcttgatagttggtcctgagccaagtattctagcaaagatggtgcagcacagaaaattctcaggtttcattttccatttagggaatgtgggagctctggtcagagacccacagatgaccccaacctcaaagctggccagctgtgctgcacccatggggagaaggagatgaggcctgcatgctgtggcagacacaggtgggtggagaagtagatgaggcctgcatgctgtggtggacacaggtgggtattgtcagcatcctgctgtcttcacagtgagagccctttcagagagtcccaaatccaagccagcctccttcaaccatccctggagaggtggatctcatagcatctgccaagagtcttgtgcttaactgtgtatcacgacagactctttccctgaccagactttaggcaggcccctctctaagctcttctcaactaagccctgactttggagcattttttcttgtctctgccttctccagttttagcaagaatcctgcttagtttggctatcctgggtatctgatcaccctaactatctgatcaggtttctccttcaccaacccccaggtggttgtctgatcaccctggtctgtgttcagcaagagtcatgttcaggtgatgtagccagaatgccccttacccttgatgtctcctgtaaataatattccatccactgatccccacctcactacctggctataaactcccatttgttttttgtatttggaattgtgcccaatctctctcgcccacttcaaaatgcaattgcagggtctctatggctctgaataaagtctgccttactgccttatcaaaggtcatttttttttctttaacaataacactgaactcttccccgaggttaaaccaaggaacattctcaaaattatatccaattatcttcctaaaaacaaaagggagttgctgtataactggtcttcatttcttccctagacaaaacaaaaagtagacttgaacatttcttaaaagactggtctccttaaattcttttagtttctcttcatttttatcaaaatataaaaaccaaattcagaatcagtttctcaacttttcaatattttctttctctattggcatctcagcatcaaagtattaaagtagtgccgtgagactcacacctccaatggctaggaaattggccagcttaggcaccaatactgcacccaagtctggaactgtagaatacagtgatgatcttgtattgactttgaaactcatctgtaagagttattcgagttttttccatggaaaaagaatgcaatattgtcaaaattgctgataacggccaagtcagggctcacagcccttaccgtctttcagaacagttgggggtgtagaaaaagaaactacagctaacactcagcacctgcaaatggccaggtgcagctctaaaccttatttgtgtgaaaactcacttaattgtcacaacaaccctacaggaggcgaatgttattatgggatccccatcttccagatgaaaaaaactgaggcacagaaaggttagttaggcagccctaaccatgtggctggtaagaagaacagagcttcaaagcctgagatagtcataacctagctaggaaaactttttagttgttactaaacagatgcagaggcatattgaaagtaaaagtaaaatgcaaaaacagaagaggtagaaagggtgccaaggtgagaagttggcagtcttttcttctggaaacttccaggagatttagaatgaaagaaagaaagcagccaaggggatcatggtaaacacgaggcagcctggacatggcatagcacccccaggctgccggactccagggcatgcccaagggtagctgcagagtcaaactaaaccaagaaacagagttgggcagtgtaaagagctgtaggcttcacgcagtgggagacaggccacccagcccacatgagggacagaaagccacttaagggcacgagctttcattagcatagaaccatgctgcccattttaccaggtattttcattgagcaggccatgggctgggtgtcctataaggcaggcctgggttcctcttcaggctgctgtcataacgcagttctgagctgcaatgattgaaacggatggaggagggagtattgggaataaacaagagtgaaggtcatctcaaagcaccttttacatttttcccgaaaggtggagttttgaaagcagaaccccttgaaaatgtgttcttgtgcatgctattccttcagactgtgagcaatttctcctctccgcacctacacgggggaaggcttccggaccaggtttctgcaaagagcacttgcgtggttcataaaagcaacaccggaactcactcactctgccttctccatccctctgggcatggctcatttccatcttaactgcatctctaagtaaatcaagagccagcgaaaggaagtatgaagatatagtggggaaccttgaacaattccttttttactcccaattactttaggtaaaactctgaatccaacttgttttatttgtgatgctattgttacagcctcaaaacctgttttgacttggaaaggcattccaaataggtacactgggaactcaacctaaaatagccagttaattttacacgcacattttattttcagggaacgtgcgtatgtcgcatacaatgaagaggggaaaatggagactggagtttatgatgtaatctttatgcgaattttattatttcataaaatgtgaatacgttcatgggaaagaggccatgaaacatattcacttttgctacacatgctgataacttcaaagtcaggtggacgggaattgacacagaattttcataataagggctgataaaatgtgctattgtgtcaacacatacttctagcttctgtttttaaatgttttgctagtaataggtttaaaaagtgatttgtttctgtttttttctttttgagatggagatttgctcttttcccccaggctggagtgcaatggtgtgatcttggttcattgctacctccacctcctgggtgcaagcgattttcctgcctcagcttcctgagtagctgggattacaggcacccgtcaccgtgcctggctaatttttgcacttttaatagagacggggtttcaccatgttggccaggctggtctcgaactcccgacctcaggtgatccactcatcttggcctcccaaagtgctgggattataggcataagccactgtgcccagcctgatttaatggttattgcctatctctttcctctcagttataggcatgtcagacctgtgtcctatacctcctgctgcgggtggctctgcatagagctcaggcagttttaggaactgtcttagttccctcagcaggagccctgcccatgtccaactgcctgtcttggtttggtggcctccccagccaaattccctcttcctctctgtatcatacaacctcccccttcccaaatacagataactgccggaatggtgggcatctgctgtgctgtgcaacgtggttccctttgtgggtgttactcacgcaaatcacgtcctctcgtggctgccaccattatggaccagggcccgtaacaaattccataacttcacaggatttgccttaagaaataacgattgccataatcgccgcggtggtggaccctgtcccggagagctgtcttctgtcaaataaaaagcagctcctgctggaggcattgctcactcccagcagcccacagtcagtaactggctgacctaggggtcaaagcattggccctattgccacaggtggatcatatccctgcagggcgctctgtgcgccagagccagcctgtgaggtcagacagaggccagtccccagctgaaaccacatccctgacttacgcagctccccacctaacccttgttcaaccaatccttcatcagtccctcgcacgagaacccccttctcaggttctacttctaggaaacccagctgtttacatttctgagggctgccataacaaacttccacatgtctggttgctttaaacaatagaaatttggtccaaaattgagatgtaggcagtgttaattcccatgcctctcttagcttctggtatctgccagcaatctttggcatactttggcttgtagacacacaactccaatttctacctccgtcttcacatggccttcttctccctgtgtcttcatgtctaaatttccatctcctctctcttagaaggacaccagtccttggatttagggcttatagtaagtccaggctgatctcatctccagatcctaacttaattacatctgcaaatactctatttcaaaataaggtcagattctgaggtaccaggagaacacgaatgtttgggaaacactgttcaacccactacaccaacctaacacatttcagcaaagtgcctacaagccaaggtaagtaagcaaaagaaagcacaggcccctgattttccctctgatgccatagaaaggcatttgggccaagacactgtggtgggcaggcagtgtggctgtgaattctaggggaagttcccctctgctaggctgcctgccctttaaacaaggcaagtgtgagagcaatcttgtaagtaagggaataatccagctaccggggcaccaggcaggatgaatttagatgtcagctgtttgaagcaactgtttggaaagtccagatccccagaatacggaagccttgaagacacagtagaagctgggttcagatgcatcccccctaccctgaaaaaggaagatattggtcccatgggaagctgaaattgggttgaggcttccccactgggaacaaggggaagtgctagctgagatgctgtccaacaaccagaagggagcttccagagcactttaagacaacagtgctttgcacaccacatcatacaggacaggcggcctgtgacttagttactatgagagttctgccctaagaccaatcttttttctctctctctgagattttaataaaagatgtagagtgaaagagcatagaagtgatagaggggaagaacaagcataattcatagtggaaagtgatgtgagagagacatagacagaggctggtgtgctgggaatcaaactgagtgaagttaatggtcaggtgaagctccgtgggttgtacatgaaggagcaatggaacagcatgggctccagactgcctgggagctcaaacagccttccaggctccactttcggaaaggtacacatgagtgacagttcctttccttctttgttgcctggccatgtggttgatgatcctagcatcttcgtttctaaatgtgtctcataacctgcagagacatgagtcagtcttattccagttcatctaaatgaaccaacaaaatgtctcataaaaatatgaagataaaattaatctgaatatgtgaaactatattaaaaagcctaaagttctgtacaaatggaacacattattagacataaataagtcatgttcatactggaagccacattcatcatcacttagttctatcacttacttcatcatcacttacttctatctcggtgagtctgagattcagcttaaacatcttaccatgatcatggaacagattcaacaaagatctcctgaatatcctcaaaaaatagcataagataaaccatccaaggtcctttactgctattattcatctctcattcagttatgcattcattcactacatggagactaaggaatgaaaatgagcaaaattattatgtaataattatataacatataattataatttttacaaaataattttgctcattttcaaacccaatctgaccccttgttgggtttgtatcataatcccaaaagacacaatcacaaatgccatgatcccaaaaattgaaatcctgaaagattgaaatccctaaagaccaaaaatctcaaagttcaaatccctaaagcctaaaatccctaatatctaaaatcttgaaaatcactatcagaaaatagttgcatcatgttaggcagatctagccatcttgttattaagcatggtttaaggcgaggaatatgggtgccaagttacccacgttgaccagtagtgacttaatgtggtcaccagtggacttaatgttaggtgttaacttgattaagaactgaaggaatacctagaaacctggtaaagtattattttgagtgtgtctgtgagggtatttccagaagaggttaccgtatgaatctgggtggactaagtgaggaagatttgccttccatgttgtcaggtgcaccatccaattcgctgggcaccaggaaagaacaaatacagaaggcaaattggaaaaagctgtcagcaacaaaagcttacaacggattctgaggcacagatccctctctctgagagctgggacagatgtttcttctgctgccttggacatcagaactctaggttcgccaacctttggactctaggaacttacaccagcagctcccaggatcctgaggttttcaaccttggactgagagacacatcgtcggcatccctggttctcaaagtataaacattggaacttcctcaataaatgaagagatgtcctttttgtacatttgtatctgtgaaagatgcaatttctggagatcttggttctttgggcgattgcaaatgcggtggcgaacctttgcagttttgattgactcgtcaaaagactaaggttgttcatcatggtatttcagacgactgtagttagaaagctgggtgcacacaataaccaaccatagtgatgtgaatttatacatttccctttttagcctgtttctttatgaatatgtgctgtctgttcctaactgttatgctcatgtgactatcattagtatacctgagtgtttatgcttgcaaaaatatttatgttattattgcttattttattgtgtaaagtggcctatcatgtttctcgatgatgtttttatgtttttccaataaatccccctttaaaaatataaataaatacctctaatataattttttatattatttcttccagaattataatttggggatttgatctttcagtgttgttattttcaggattttagactttgcaaattttgactttctaggatttcaacattcaagattatggtgttctaggtactgtgtctttcaggattatgatcagctgcccacttctatttgcggatgagacagatttaatcaaatagtcatagaaatgaaagaaaaatcacaactttgataagtactacaaagaagatctctgatgctctgagataatacaagagggtaaattgatctattaggaggttgcagttgtggagcaggggttgtgagggccagaggaaggagaaaggccctgcagacagagagcatatgatgtgtgcacatcccttagacaggaggagtcattgtggactagcagaagagaaaagagcacagaaagccagatggagcatgatttaaggtgaaggtggaaattctctggggagaaggctgttcagggccttggggaccaacgtaaggatcctggtctttgttctatgagcaatgggcagcaaggagcatatttcaagcaagagattaatataatgagagtgttcttcttaaaaaattacatgtggcttttaattcaagatggtagaatgagctattgatattccctttaagcttccttaaaataagagtaatgagctaagaaaagagggaaaatcattatggcaaagaaaacaggaaaagctgtcagcaaccaaaagatgtcagcagattctgaagcaccgatctctctcactatatcttagtctgctggactgctttcacaaaaataccatagactggatgacttataaacaacatgtatttctcacagttctggaggccaagaagtctaagatcaaggcactggcaggttcagtgtctggtgagggttcattgctcatagttggcgccttcatgctgtgtccctagatgatggaaggggccaatgagctcccttgggcttcttttataagggctcgaattccactgatgagagctccacacttatgacctaatcacctctcaaagactgcaccttttactaccatcacattggggattaggttacaacatataaatttggtgggagccgaaaaccttcagacaacagcacatcataaagcaacaaagactattccataacccttgcccacttatataagtttccttcctatctgctcaatctttaatataaatggaaatcaacagccatcagatattcaaggaatgcttgcatcatgaaggaggaagaccaaggcaacaaatataaaaatacaaacgttggatgaaacacaattcagaaaacgggagaaaacgaaaataatcatcatcatcatcattaagaattccaggagataatctatttgtaagacaaaaatagaattgtgatgaagaatgtgaaagagacactaagataaataaaatacagaatgagaagactaaatagataactaactggaatctcaggaatataaaagaaaatcattaaaaagatacaatttttagaactatcagaaaatatgtattaaaaatcccaaaagtacaatatactgagataaataaaatcagaatatataaaaagaaatttgtgtccaaacacactttgacaaaattacagaacatcaaaaacaaagaggagatcttaaatgaagccatagagcaaggacaaacagcctacaaaaaggaaacaatttaaatgacttcagactttccaacagcactaatgaaagctagaagataatgatattttacctccaaagtacaaagggaaaatatatagtcagtacagaattgtgtgcccagccaaatactcttttatgaaaaagataaaacaaggatgggtaaagataacaaaaactgagagggtatgccacaaagaaacctgaaataaagaaaattctaaaggatatgcttcaagaaaaaggaacacgaccttaaaaagatggtttgggatccaagtaagaatgaacaaatgaaattataaaacagtaagcaaatccaaagaaataacatctgaataagctaataataaaataatacctagtatctgggttaaaaaaaaataaatatatagaagtagagaaaacaacaggagcatgtaagttttgtttgattgtttctttgtttttgagacggagtcctgctctgtcacccagccaccgtgcctggcccagaagcatgtaggttttgaggtgagtgttcagaatcaaaatgctccaaaacctgcttttgttttttgtttgcttttcatggaagaaggtgcttaggttattgcttaattgcagacttttgctaatttaaatgtacatggtaaatttccaaggtaacatctaaataaatggaaatagaatatatacattctaagtaagtacagtaaaagtaaaaaagaaaaacttattaaacaaagaaagaaggatgtataaggatgataaagtgtgacaaatagaagtcaaaagtaaggtgtgaaaagaagttcagtatatcaaaaatcataaagaatgtgggccgggcatggtggctcatgcctgtaatcccagcactttgggaggccaaggagggtggatcatctgaggtcgggggtttgagaccaacctgaccaaaatggagaaaacccatctctactaaaaatgcaaaattatccaggcatgatggtgcatgcctgtaatcccagctactcggtaggctgaggcaggagaatcacttgaattcgggaggcagaggttgcggtgagctgacatcgtgccattgcactccagcctgggcaacaagagcgaaactccatctcaaaaacagaaaaaaaaaaaaaaaaaaaaaaaaaaagagtgtgagtagactaaacttgtgtttgaataatcctgcccatggaagggctcagaaaagatggaatagctaactattgttttctactatattagacttttgactttttaaccttgatcattttggtgtatttttaaaaatgggaatgaaaggtattttgggctgaagtatgaaagaaggagagtagagagaggcaagacgggctattaggatgttattaccatagcctgactgactgatgataaacacacttaaactttttaaaaacttcctcaatcatttcatggaatggattctgacgaagagaaattttggttcagacgtcagtattaatttttaatatgtattgccaaatttatctgaaggaagtttatacccttcaatgctgttacacatttataacattttcttgtaaaagtactcattgcatgcgtatcaaattcaggcactattccagtttacaatagggaataagagaggcgaagctgctgtcctcatggatctgccattccagtggggaaaggtgaggaagacaaatggtataaaaagcaaatcaataaataattttatatgataaaaagttaagaggaaaataaaataggtgagttgatgggaggtgacttcagaatacatagtaagtgaaggacccttagccaggacttgagtgacctggagggacagccgggcctggcaaagggatggcagtgtaaagagcctgaagtggaattacctgggtatcaccaaggaatagaaaaatgcccatgtggccactgcatagtgagcagagggctgggtggggtaaggaaggtgtgcagagaccagatggtaaggagcttgggttttctttaaaaaagacaactaagatttatatatacagctatatccatgggaaggaaaaaacagacacctgatgtacagatcaaattcagaagtgtgtcctcattcacaccatgtaggaatctcacctttacaagcagagttaggagcctagggctttctacatgcatcttctcaattataacaatcgcagatgtagatgtcatcgtctccatttgaatgtcaaggaagcagagccagacaagtcacactgcttgtaaatagcagaatctggccttaaatgcaagttgtgctgaagcacgtgttctttccaaacaaagttccagagcccatgttctttctatcagaagctaagggaccacccacctgcatactggcatgatgaggctctagaaactgacatgcaacctcttggccacctaaactttgtaaaggtgacttgggtttcagtattttacttaccatttataattttgtgcctcacctatttccaaatataaacgtgtgtgtgtgtgtgtgtgtgtgtgtatatatatatatatatatatatatctcctgttatcctatttatgaactaaaaatattataagaaacttgaaaagtcaagtgtgtggagtgttaccggctgaaatgtgtccccacaaaattcatgtgttgaatttctaatccccagttgctcagaatgtgactgtgtttggagatagggtctttaaaggggtatttaaggtaaaacgaagtcatatgggtgggtcctgttccaatctgactggtgtccttacaaaaagaagagatgaggatgcaggaacatgtagaggggtgggcctataaagacacacagagaatggcctcaggagagtccagcttcgctgacaccttggtctcagaaatccagcttccaggtttgtgagaaaataaatttctgttgttgaagccactagtctgaagtactttgttatgggaccctagcagactagtacttgaattgtttatgtacactaaatatggtataatactagaatatttctgtggccatatttcaggcgattgatgtagttaaattccacaaaatcaaaacaagatgtttaacatgtatctcttgaattattaatagtaacatttttttttttcttgagacggagtcccaccctgtcacccaggctggagtgcagtggcacaatcttggctcactgtaacctccacctccggggttcaagcaattctcccacctcagcctccagagtagctgggattacaggagcgtgccaccatgcccgggtaattttttaacatctctactaaaaatagtagagatggggtttcaccatgttggccaggctggtctcaaactcctggcctcaagtgatctgcccaccttggcctccccaagtgctgggattacaagcatgagccaccgtgcctggcccattttgtacattttaaattttatcatgtgtttactttccagcatatagaacggcagaacatcagattagtaaatagcattcattactgcaatcactcttccaatgtacatacaattgactctctgaacaatgcggatttcaagtacacaagtccacttagacacagatttgttttcaaccacacgtagcttgataatgcagtatttgagggatggaaaactgaagtatacaacctttttttatatgcaggttatatagggctgacttctgaacttgagtatgcctggattttggtatacttgggggtcccgaaaccaatcccccacacatacagagagatgaatgtactaagctcacgctgtgagctaattaacttttctttgcatttccatagaaaccaccccaacccaggccattattgcttctcaacagacctcagctatgtcctacttacattctgtagccaaactgcactaggtttcatcattaaatggtcaagctactgcatcttcttcccattttcctctactttaaataccttctcttggctgggcgcggtggctcacgcctgtaatcccagcactttgggaggccgaggtgggcggatcacgaggtcaagagatcgagaccatcctggctaacacgatgaaaccccatctctactaaaaatacaaaaaaaaaaaaaaaaaagaaaaaaaaaattagccaggcgcaatggcgggcgcctgcagtaccaactactcgggaggctgaggcaggagaatggcgtgaacccgggaggcggagcttgcagtgagccgagatcacgccactgcactccagcctgggcgacagagcgagactccatctcaaaaacaaaaaacaacaaaaaaaaaaaccttctcttctagtcctgccagaaattaagccccactctccaagcccaactccaatggtatcacgtccagcaactatttcctaaccaactgaccataagtggcctctgcctttcttaacttctattttactttgaatcggtaatgggctttcattttaattattagcctaagcatcttagttttcatcctaaattacaaacttctcacagaaaggaagtgtggcttgtgagttttaaaattacctcctggttgggcgcagtggctcaagcctgaaatcccagcatgttgggaggccgaggcgggaggatcgcttgagcccagaagtttgagactagtctgggcaatgcggtgaagtcccatctctacaaagaatgcaaaaaattagccagggcatggtggcatgcacctgtagactcagctactcgggaagctgaagtggaaggatcatttgagtacaggaggttgaggttgcagggaggcatgatcacaccactgcactccagcctggtccatagagtgagaccctgtctaaaaaataaataaatataaaataaataaaaaaaaatcactttctgctttgtacatagctgggattcagtctgtacttattaaataaataagtgtcatattaagaattgcttctccgtaatgcaagtgaccttccacttatttttgtatggtaaattttagttgagaattcaggtgggtcacactttaacatgactgccctgaggcggatcacatagggattacatcatctaccttcatgaaacataggagggaaattcagattatggagcttatgtcctgaacctgccaggggaggttgctggtggtatttattggtatttttcttcatccttgagacaaacaatgcaaccaaattctttacagaaaagagagaagggagagtgtaaaagtggacattggataacacctaattcaataacaacattccgaagaaggagtcagacattgctgagactgttacatagcagcattagcaggttacagttctcactccaggaaggtaatttaccctaaggctggcactgatttacaatagatgaggtgcgggcacagctcttcagtgttgaccagcaccggcacatgggattgcagcaataacctgtgtaacacagacagcaataccaaaccgtgcacttggaagccagggatggggagaaattgatgtggaatgtgtagctttaaacctgctactatctgcatgtgtgtgtacgtgtgtgtgcgtgtgtgtgtgtgcatgcatacatgtatgtgtgtcaaaaatagcaagaaaccactaaaaggcctcagttccacttttggagaaaagccattctttaaaaggactttaattgggaaagtaatatctgctgcgggtgacacaggaaaggcatctgtggagtcacgtgacacataaagaggaaaaggcccacacctctcaaaaatcactgcaaagaatcccgagcaatggagtggacagcaccagtgtggtggaactcttggaagacgctttcaacttgtcacatgtaaaactgcattaaaatgtctttcatatgtccatgagcactgcattgttgaaggcaaatgactgtgatgctttaaggatgcccaatttgaagaatccattgcttcctaaagaactctggggagcatagctcaaagtagcctaaaaaatcgcattcttctctttcttcacatacagacctttaaaaaattggaaaggtcaaatttgcttctgtatataatctaataggtatgcaatatttttggagaaaagaaaatattttaaaagaaaattttcttttaaaacaaatttataaaataactcatcttttattattttatttataaatatatacaaaaatatataaatatttttatatatttataactatttattattcattttattagagaatatacaaaaacatgtgatatggttctgctctgtgtccccacccaaatctcaccttgaattgtaataatccccatgtgttatgggagaaacccagtgggaggtaattgaatcatgggggcggtttcccctatactgttctcatggtggtgaataagtcttacaagatctcatggttttataaggggttacccctttcgctaggctctgattctttcttgtctgctgccgtgtaaggcgtgcctttcaccttccaccatgattgtgaggcctccccagccacatggaactatgagtctattaaacctcttttttcttataaactacccagtctcaggtatgtctttatcagcagtgtgaaaacggactaatacaacgtgctttggattaacatacagaaacaagtcaacatttattagaatctcctttgcacaaatatatttgcaatgggccgaatatctgtgcctccccaaagttcattgttgatatcctaacccccaatgtgatgttattcagagatggagcctttgggaggtgattaattcatggaagccctcaggaatgggattagtaccctgatagaattgactccagagagtgctcttgtttcctttccactgtgagaaaatacagggaggagatgaccatctacgaaccaggaagcaggccctaaccagatgccgaaccttctgctgctttaatgttagactttcagcctccagtactgtggggggagaatgttggtttttgagaagcacacaggtgtgacattctgttatagtagcccaagtgaactgagacaatattcattctaaacaaagctgaattatggcctattttattcatttgattttttatatccatttaaaatataccatttagtcttctaattcataaagtctaaatgcacagaaagataacttccaagtcaactcgatgattctgcactaaaagctttttagaagtagagaccaatacaaataaaatggaaataaatttagatgtgggcaaaacaatttgcattgagccacaaacataaactatctttggtgagatttaaagctatgaacctgcaccacactgatgagcaaatctgtgagaaatctcatttgaggacctcctcagttgattgtctattatcctccaggagctgtgataacactaataagaaaatactcccttgtagagagcttcaggagctgtaagagaaattattcaatccatccttgtacccttccttgagctcactgtggaattactctgatggaaaactgcctttgtggtcccaccatggaaaaggtgctcctgaagtttcctaaaataagggcaggaaggcctcactggccaatacacttatcaggagaatagcagtacagacttttaacaaaaaatagagagtactttcaataaataaagcataaaagtaaggctttcgtatgctgcctaaatcctaatcttgtacatatctttcagttaccacagtatggcttcccgccaacctctgggatgtggcatgtaatgggactcccaggatgaaaagactcggtgtcctgtcgttcattcattcatttattcattcattcagtcatttaatatgtatgtatctgtctatgctatgccaagaaaagccatgggcattgggatagagcagtgaggaaaccaacacatctgcctcctcagagaatttacagtccagaagggtagagacagacccacataaaatggtagactactagtttctttcctttccacatactcccatcatcattttccattgagatggtattttttccctaatgctgatatgcaattatctcatctaaaagaaatcatctggccggacacagtggctcatgcctgtaatcccagcactttgggaggccgaggtgggcagatcacctgaggtcaggagttccaggccagcctgaccaacatggagaaaccctgtctctaccaaaaatacaaaattagccaggcatggtggtgggcacctgtaatcccagctacttgggaggctgaggcaggagaattgcttgaacctgggaggcggaggttgtggtgagctgagatcgtgccattgtactccagcctgggcaacaagagcgaaactcagtctcaaaacaaaacaaagaaagaaggaaggaaggaaggaaagaaagaaaaaaaggaaggaaggaaggaagaaagaaagagggagaaagaaaggaagaaaggaagaaagagaaagaaagaaatcatccacatataaacttcagacatgcaggtaccatagtcacgggctcccagtccttgctacctataatgaggtccacgaaccagcagcatcagcagcacacgggagctttttagaaacagtcttgagcccacctggacctaatcaatcagaatcttcagtttaacgagacacccaggagacttgaagggacactgaattttgagaagtagtgcacttagatgttttctcaaaaggtgctgcaggggacatggcatcttcatgctaagtgaaaaagccagacctttggtcaaatagagtgagaaactgctggttaaggcaagtcagtgacttcttcaccttgggattcgtcagagttccttatgtctattttaaatacccaagagaaagaaaccaatactaatcataataatggtcgtaatcactaatatttatagtttagttactataggctaccactaaaattgcttaaatatgatatggatatggaatcctgtttaatcatcagtcagtccccaaaatttggtgttattattcttatttttcatattacgaatctgaaactcagagaggctaagttactttcccaggatgacacagtttgcaaacttgccaactgggaacccagccctgcctgattccaaagcccaagggctcgatttgaaacgtatggcaattttctaaatacattgaatcattgaacatggacacagcttttttctattttgcaaagaccacctaggactagtccatgaaatacaggctgggaaagtatttcacagaaacacatttgccaccatgtggcaggtccctactcaggggcagaaacaccctcaaaagtgatgtcaatcttaaatgtgcgggcttgcatactagccactcagaagagcacaaaacaatttaaggttttttcccagacctgagatatcaattacatcttgccgaatgatgtgtcctaactggcatgccactatcagatttaagataaaaatcacatgtggcctagtctagacacactggacttctgtaatctcttctcattgtcactaaacagctggtacaaatgaatctaccacttcctcatatcaggcccctgacttaatgtctcaccccatttctcaagaaaagatgcacgtccctcataatgtcaaaacgattgggttatcttgcattgtttacaattgaacagtggttcatcttagcagtcatggtttatttatactcacttttattcatccattccactcatatatattgagttcctactttgtgctaagaagcagttcggtgtaataccaggcccttcacttttacaatcatgaagtcaattaattataagctcaacccataattaatatactcttagtaaaggcaaccattataagtacattctgatacaacattctatccatgtataaacttaagagagtataaggatcagaattcgaggtcagacccacaaaatacagggaaaaaatgacactatgacattaatcttctccactcctcccccaattgtatactgaggaaatgagttcaaataatcattaatagcaaacctgaagtagtaaaagagaccacagaaaaacagacactatgatagataaagaggattgaaggcatctgctgggtgtcaaagtttgccccaggttaaggatgtttctctgacctacaaaaagcttggactgtctgtggaacatccaagcaaatcaacaccagaataaaacatgctgtccactttcctcgccctcttccaagaattacttcattattcccaataaactaaatgcatttagttctgaaatgaatgcatgttattcaataagaaaacattatgactcaagtagacctacacttcttttctgaaactagatttctgtgctctgaataaaaatgaacaattcatcagcacacatttcttcttaatctaaaaggacaacattatgcaaattcaggccatgggggtgtgaccctgtctatccttacttgttttgtttgtaagtaaatttggttcccctttgtgttaaagtgtaacttttttttaatgagaaaaataacttttgttttataccttcactagaggaagtactgtatctcagccatcccagtcacaatgggaacataagcatggcctcctcagtagaaactcattcatctcttatccatataggtccctttcttccatctgctttttatttggaagcactcattcttatctccaacttccccggcctcaaggtagtaatgttaggtaacttgcagtgatagctacttttgaccactttctccaagttccagcatcctgtaaattcatccatttaggcccacacaatatgtctacctccctagagaatgttccatgtgaacttcttttaaaatatcatactctcttttctgtaaaagcatatggaagggattctgtgacgatttaaaactaaagccacaatgcaacttctaacttaaaccagattattgcaaggacagcaataatcaatcacaaagattaatttaacagttgacctttttatactgttttatggatttcagcaaccatatagcaccacaatttagaggtagccttaaaagaactgttttctgcttagcaatcagaatctaattttagaattcctactagaaaaaaatatgagtatttttatctcattgcctggcgcatagtcggtattcattatgcttggaaaaaagtattactaggggtctgtgaaaagcattttgctacaaacgcttcatcttatcctttgggagaatcagaatattgcatactcacctgttggaagggtgccgatagagcagagtttgataacaccaagaagacagagaatgaaaccagggaaacattaagaccttcaggacgacgaggaaagatagctgatagccggaagaagacaatcaagattaaaaaaaaaaaaaatcacactttcagagaataacttaaattttaatcttttggctccaaagaaaaagtgacggccatggaataattttctgatttggccagtaaatcaggcttaacacctgctctagaacctaagcatgctggatatgacaatgagacatttctgtagctgagcagctttgtaaataattgggacaaaattctataatcatagcagctgcttcattatgtcctgataagctgcctaggtaattaaaatgtcacacatgatgcaaggagtagattgattttttttttttttttttttgagatggagtcttgcactgttgcccaggctggagtgcagtggcaccatgttggctcactgcaagctccgcctcccgggttcacgccattctcctgcctcagcctccccagtagctgggactacaggtgcccaccaccccgcccagctaattttttgtacttttagtagagacggggtttcaccgtgttagccaggatggtctcgatctcctgacctcgtgatccgcctgcctcggcctcccaaagtgctgggattacaggcgtgagccaccgtgcccggcctctgctgtatttcttaaagttagatgttcattctcagcctcacaggacagaattctaccgttaggagtcatgaaatcagtggtgggaagcttgaccacacaaagtctatatggctctgattggtggctttgccaatttagcggaaataggtcttgtttgtatttcctaactagggctgagtcttctctttgaggctcagtacagaaacggatgatttcttatcctttctaatatcagaggttcacaagccactatctggagctcacaggagccatacaccttttggttaaatagccccctaggatgcaaacgtttttctttctttcttttttttttttttttttttagatggagtctcgctctgtctcccaggctggagtgcagtggcgcaatctcggctcactgcaacctccacctcccgggttcaagcaattctcctacctcagcccctcgagtagctgggattacaggtgtgctccgtcacacccagctaatttttgtatttttagtagagacggggtttcgccgtgttggccaggcaaacgtttatctttctcaagcttctcgtagttagctttttcttactggccctgattagagtttactttatcttacccttaatagaacctatactagttctgacagctcgttttgccctctgcaatgaaattgctttgagaattcaccatccttcatgggcttgaaatttaaagaacactctatgggatgaagttgtataaatgattggttgattgacttgtggagggagtaattgtgtgttatgagggtgtgtgtgcacatgtgtatgtgagtgtgcatgcaagcctgagaatgttgtctctagtgtaacacagcatcacagatgtttgggatgctatagcatacagcacaaaaaataaataagaatttgtaacatgttctaggaagcacataacaagtaaatagtaagtattccactcagatttgttattccacccagaatgcacagttgatgcttcataaaacagggaaaaggtcttcatagaaaaatacattcaatcggccaggtgcagtggctcatgcctgtaatcccagcactttgggaagctgaggtgggtggttcacctgaggtcaggagtttaagaccaccctggccaacatggtaaaaccccatctctactaaaaataaaaataaaaaaaattagccgggcaaggtggcacctgcctgtaatctcagctactcaggaggctaaggcaggagaatcgcttgaacccaggaggcagaggtactccagactgggcaacaaagcgagacttcatctcaaaaaaaaaaaaagaaaagaaaaagaaatatgcttagtactgactggctgctgaagcaaaagcctctccaagccatcacgtggacacggctggatggcaggttgtgtttatgtctatcttccaagaagctctaataaagcgtgcaacactgacaatatccgcttacgttggcttagtattgctatttatattgtaaatagaataatgaaattttaaggccaggcgcagtggttcacgcctgtaatcccagcactttgggaggctgaggcgggcggatcacgaggtcaggagatcgagaccatcctggctaacacggtgaaaccccgtctgtactaaaaatacaaaaaaattagccgggcgtgctggcgggcgcctgtagtcccagctactcgggaggctgaggcgggaatggcgtgaacccaggaggtggagcttgcagtgagccgagattgcgccactgcactccagcctgggcgacagagagagacaccgtctcaaaaaaacaaaaagaataatgaaattttaaaagatgtcattatagttcttggagtcgagacacagtaaaatgctttcttgccctattcctaagaggcttcataattgttggagctataaatcaaagtgactctcctcacattgtcttcatcccaaccttagggactcaggccgtgaagctcagcactgcagtccatttccccacagctcactgaatgtagattgacttggggagtgctgcttcctcacgatttcaggactagagatggtgtcttagttggtctgggctgccatagtgaaagaccacagactctggatcttagcaacagaaatttgcttctcacagttctggaggctagaagttagagatcatggtgtttggaggtaggttttttcctgaggtttatatatggtcgtcttcctccgcacgtcttcacatggccatccctctttgtgtcccggtgtcctaatctcttcttcttcttctttttttttttttttttttttgagacagagtctcactgttgcccgggctggagtgcagtggcgccatcttggctcactgcaacctcaacttcctgggttcaagcaattctcctgcctcagcctcctgagtacgtgggactataggcatgcgccaccacgcctggctaattttttgtatttttagtagagatggggtttcaccatgttggccaggctgatcttgaactcctaacctcaggtgatccacctgcctcggaattacaggcatgagccaccgtgcccggccatctcctcttcttaaataccagtcttacatggaattaggggccaccccaatatccccattttaacttagacacctctttaaagatcctatctccaaatacagtgacattaggagtttacagcttcagcatatgaattctggaggaacatgattcagtccataaaagagagataaacggatatgtgactgagaatgaggaaagacagaattctgccatcaggaatcacaaagtcaggggtcttcagatgtcactgggataaagagaatggggcagtatggaagcctatgatacctggagaggaggggacccacatagggccagaataaagaaataaaactccttctggccaagcaagacatctgtgggctgagaccatccgttttctacccctgctgtagagtttctgacagctctgaatgttaattgaaagctgcctggactggcatttgtggcccagctggtgttttcttattttgtgtttgctttttgatggatgatgagtgttcagtttgttatgagattctggggaggaggggagctgattctcaggccatatttagttcttagatgtatatttaggtccaaaaggtaaaatacataggccacataatttcctgagacatttgctttttttctatacataatagaaagaactcatttctgcagactgaactaaaacataaggtgatagatgtttgcacgtagttaagaaatcaggcaaattgttcatgtgccagataaaatgttattgaactcttagtccttcagctgctgggacagatgggcagtaggtttcataccacgtgccaagaagtggctggctggaggcctgtgatgggagggattctgaggtttagactggacatacaaaagatcatgatctcattaattggccatatctgccaagaatgcggagagagggtttgcagcattagaacatgatggcacaggaatcaaagcaactttccaggatactcttgtcttgggtaaggtccattgtgacttcagatacataaatcccttgctttttaggtacaaaaaatatgaaattgttctggtgttttattttattattattattttttgagacggggtctcactctgtccccaggctagagtgcagtggtgtgatctcggctcactgaagcctctgcctcttgggttccaatgattcttctgcctcagcctcccgggtagctgggactacagacgcacgccaccatggctggctaattttcgtatttttagtagagacggggttccaccatgttgaccccgctggtctcaatctcctgacctcaggtgattcacctgcctcggcctcccaaagtgctgggattacaggcatgagccacgatgcctggactgttctaccattttttataggcccaacaaactcaaagagagaatgaagcattttgtctggcttagacaaaaaatcatgtgaaatataagaagcacaaaaacctactctacggttttaatatgaaatccagagagacaaatgcttattagttttgttgtttgtggggttggtggttagtattttgcgtttctgattttttaaaaaattttctctataataagcttactgatttttcctcttaaaaagcaatgttctgtgggaaaaggccaaccttccttggcactgccttctttttctagagattattaatttctttttaatagagctcatactgcaaaatcaaatttttatatcgcaaagggatttacatttatcttgagctgcacactcttcgtctatcaaattgagtttaagtttctaattgaaacaatttttcaagtgttaagcaataaagaagcaataagtgatatatttaaattatttattcatcttatttataattaattcatttttttccttgctgcacagtgaggctaacctgatgcatttgatttttcaaatcttttctatcatttggcaacaatagaagtggctgctttttccatcccacttgtgtttcattggtctttggggactcaggcaacatcagtttaaatcacagttaaacttaacacagcaactttgttttgcgatatactgcaccaaaaacaagtgtgttatgagtaaagcacgcctgttcttagtcaaattggaaaaaaaaaaaaaaaagtacctcttagtaaagtgaaccattgcatcaacaaggatctcaaccttcagcatttaatgactacttatcccttggtctatactccttctacacaataagattgataggcctttaacatgcactgtgtcatggatcatcaactagttgacctggatagctggtctgcaaattatttgaacccctttttccaatatctctgtcttgttatactattcacaacacaatctctcggctccagttgaatgcattacctcctccatcacataaacttattgcctgtccaaaattgcctggactgataatcttcaggcctgttcttagtcaaattgaaaaaaaaaaagtacctcttagtaaagtgaacaattgcatcaacaaggatctcaaccttcagcatttaatgactacgtatcccttggtctatactccttctacacaataagattgataggcctttaacatgcactgtgtcatggatcatcagctagttgacctggatagctggtctgcaaattatttgaacccctttttccaacatctgtgtcttgttatactattcacaacgcaaactctcggccccagttgaatgcactacctcctccatcacataaacttattgcctgtccacaattgcctggactgataatcttcagagctatgcagccactggatattttcctctcacacaaacacatctatcccattcactacaccatgctctggctcacagccctataatctcactccaccaagtgcccaatggcagaggctccaacaacttacatatactacccacaattttttttttttcgaaatccaaggtcatattcctggactgttcacaagctatagtgattccccttggctaactaaatatgctcaagctccccagactcctatttatttaggctggatttcacctttgcaccctcatccagcactgcctggcaattagataacagtgaatgagggcgtctatgaagagtgtactcacaaactttcattaaatagtaaccacactttatatgaatctttgctcctcacacaacagctgactttcactggatgctcagtacacatctgtagaacaaacgacccaagaacaggccataaaacaaattcagagaataatcaggggaaatctagtgatctgaaactcaagtcaaaaactcagaaaatatgatggccaggaagaagtcaatcgttgtctaaaattatttggaaataactgattgtgtagtaatccagttttctttaactgcagatgcctcagatgatctgattgtttggtatttagtgggcctcagtatgtttcatgtatcatgaaaggcagggagagggacttttctcaacctcaagggtacagcaactgtgcagtgaggactagggtgaagtatgagaacaaaaacaaaagcaattataattacaggcatttattgagcttctcctaagtgtcatgtaggtacaatgtactatccattttagcttattcaatcctcaaaacaatcctgtgaaaataacaagagtacatagctactaagtcacaatggaaaagtgtgttcttgtcccaactcttcactccctttcctgcaggaggccatatgtctatacacgctgtgtgcagaaggagtctacttccctgcttcattgacatcaggcttggccatgttcctgactcaggccaatagcatgtgagtggacatgacatcggcaaatccgagcagaagttttagtcattgtaggttcccaaaagatgagggtaaaatggcatgtcccagagaaggctgtctttaaagtggttcccagaatttgcacacttgtggccaacagtcagtccaacacgtaatgtgagcacaaaataaatctttgttgtcattgatcacagagactataggggtgactggcactacacaaagcttagcaaaagtagtggtagaattcacacccagagcctgcacttttatccatgttactatgctgcctcactaagcatacatgcactattatgagacaaggttctaaatctatgtaggcaggttctgctgtctctgtcttgcaagttggaatcagtcagctactcaaagtatggtccatggaccagaaacagtatgagtaatacttgacagctggttagaaatgcagaatctcagctcccacccaagaatctgcattttaataaaattcccaggaatgaatgtcacaataaaatatgataagtgctgatttaacacatggtcatggacgcatatgcttcatgaataatcaagatcaaagagctatgaattagaaatgaaaaaaagcatccacttccaattctattttccagattggaaagacaagagtatccacttattttccttgtctcttggagatcagaggggtagaaacaatgtgttgtaactacaatggtttactgtaaaacattctaggacttgctctagtcactaaatatcaccctttgatagagcagcttacacctcattgctagtcacgctgacctcttgttcacaatccaatagcatgttcattgaacaaataaacattagggcctatttgtcttcattaaggactgtatgcttgtaggggaaaaaatgacacattgtgcttatcttgacttccctgttccaagatcccattattgtcttatcacccttttgatgagtgacattgaccattaaccatatcagtaaacatcacagcttcctaaacacaagttctcatcataattaagggaggaatataacacttatggatgctgcttagccggtaattcaatgtcatggtctcttctccacactgttgcgaaacccagtagcagtgaaccagaacatccaagaagtaatggaaatgaataatgatatttcaagatggtggatgatgtaggtggaacaaccacttgtgcatttgagacacattctccccagtgaacactaaggtttttgacaggctggtttatgaataaattcatgacatgagacatttccaaaatgtctgttaagaactgcttcaaaatgaagtcatcaaaattactgcaaaatgtacattttaaatgcaaacagccaggggaaagagtgtacttgttatgtagaattcattatctttatttcggagtgcagccctataaacatttgtttgggattgcttttatgcaattgtttggaacataagcagagaaagagctgaatggagacattccagaaacccagagcttattcagcttcttttttctctaccttgatagaaagaaatcatttttttcttcaaatttaatacagttgtaaggatctggtgttttctaatttatcagtttatgttgttaatagtggggacattaccaaaatatgaaaaatggaaaccatgtactaagaattttatcttgtcatctgggacaaaaaaaaaaagatccttcattagatgcacattactttttttaggtatttaactcacaatgtaagtatgtgcatatttacagaagatagtaatactatccttatgtttgtaattgaattcagcctggagccgctttaagatgaatcagactatcaagttagccagcagatttagggtcaaaaatatactaagtgggaaaaaatgttcttaatacagaataagctaagtggttagttaaggactaaaaacaccactgctccaccacgaagaaggaaatatgcatttgatctaaaagaagaaaagagttaaaatccagtataccatcaagacaaaagaaaacctatctgtaaaaaaaaagagaatacaaatcatcacagacacaccctaaatgaaaatgccaagtagtttcgattgcatgaaatttattaatgcttatatatcaataaagctcaccataaacaaaattaaaaggcaaataatgacctttgaagattatacataccttttaaaaattaataagcctagcatttataaaagcttgcaaacctatttttcaaataacacaccaaaaaagaaatgagcaaagcacatgaattggcaataataatatttcaggaatgacctgaatctacagtagaggatcagctaatagtagcagatacatacgataaactaggatgttgtcattataagtgtaatatggaagaacgtctactgatgtgaagaaaatgttcatgaagcagtaaaaaaagaataaaacaatcacctaattgtaaatgtttaataaaagacataccagactgttagcagtatctctctacattgtagaactacaagagttgcttttttgtgtgtttcaagtgttttacaaacttcacccattcagtatatattgctcttcaattaaaaataaaataaaggtcatacaaaattaaagagattaaaattagaacaatttagataaacaaatttaccataaaaacaggaaaattccattcccaatgctataaaactatagcctaagccattaaaatgttttacttctaaaattaagctactgacttttggaaaaatgttattaccctataaagacatttttagatatccacagttaagtttgtaggcaaaggatggtattgaggtgtgtaaagagaaagcttggaccaaaaagaaaattttatttttttaattgagagcctgtgtttgtaagtaacatcagtgattcccttaccaaaatacctgttttactctgggagtgaaatgagttaaaagaactagattgctggggctttggggtaggtgatgcttcctctctaatttgaatctatattgccaataggtaaattgagagctaacacattaactcaaatttattgctgacattaccttccctatgcaggaaaatcaataatgaatatacattggaatagctgattggtgaaactcagagaaaaaaaactcaaagtaaattattctacagtattagattcttattgccactataacaaattaccccaagtttggtggctttaaacaatgcagatttattctcttacaattctggaggacagaagtccaagttcaatttcacagaactaaactcaagatataaactgggctgcactccctttgaaggaacatggggaatatctgatttccctttttcagcttgtaaagcttttccacctcataaagtctttttcagcttgtaaagacctcttgaattccttggcttatgagagacacatcattccaacctcttattccatcatcacatcttttactatccttctgatctcctgcctttctcttttaaagattcttgtgattacattaggcttaatagttaatccaaaataatcttctaatctcaagagcctaaatttaaatacatctgcaaaattcctttagccatataaggtagcatttacaggttttggagacagtacactgctttggtttgaatgtttgtcccctctgaaactcatgttgaaacttaatccccaatgtggcaatattgaaatgtggacttttaagaggtaatccatttattgattaatagattaacgagtcagtggattaatagattatcacaggagtgacattagtggctttataagaggaaaaacggagacttgaacaataactaagcatcctcaccatatgattccctgcaccacctcaggactttacagagtccctcactagcaaaaggacctttcaacaaaatgcagccccttgaccttggacttctcaacctccataactgtaagaaataaattacttttctttataaattacccagtttcaggcattctgttataagcaatacgaactaagacagaaaattggtaccaggagtggggtgttgatgatagtgaacacctgaaaatgtggaagtggctttggaactgggtaatgggcagaggatggaagctgagggagcaggctagaaaaagcctggattctggtgagggcttagaaggcaagaaaactaagggaagtttgtaactccttaggaattggttaaatggtggtgaccagaatgctaatagagatatggccagtaaaggccattctgatgagatctcagatagaactgaaaaacaaggtattgaaattttgagtaaaggccattcttcctataaattggcaaataatttggttgaagcgtgtccctgcccaagggctttatggaaggccaaacttaagaatgatgaactaggatatctgacacaaggcatttcttctttcttctttcttactttctttttttttttttttttttaaacggagtctcactctgttgcctaggctggagtacagtggcacaatctcggctcactgcaacctctgcctcccagattcaagtgattctcctgcctcagcctcctgagtagcttggattacaggcacacaccaccacgcccaactaatttttgtatttttaatggagacggggtttcactatgttggtcaggctggtctcaaactcctctttctttctttcttctccttttttttttttagatggagtttctttcacccaggctggagtgcagtggcttgatcttggctcactgcaacctccgccttcagatttcaagtgattctcctgcctcagcctcccaagtagctgggattacaggtgcccacccctacacctggataattttttgtgtctttagtagagacagggtttcaccatgttggccaggctggtctcgaactcctgaccttgtgatccccctgccttggtctgacacaaggcatttctaaggaaaatataaaaggagctacatggttacttttggctgcttatgctgatatttgggaccaaaggaataatttaaaaacataatttataattaaaagagaaacagaacagaaagatttgaaaagctctcatcttggccaagtgaaaagttaataagtgtgttcaggagagaaaatcaagggtgtagctcagagaccatttgctaaacatattagtatgaatagaagggagccaggtgcttttcctcaagatagcagaaaaaagagatcctgaaggcattttaaagatcttgaggctgcctctctcatcacaggcccagaggcctaagatggcagaatggtttcaggagctagaccaagggcaccctccataggctcagtgcccaaggccaccagaggactctgtttcctgcactccagaacggtgctccacaactgccctagttaggctcaagagaccctaggtatggcttgtggcacagctctggaaggaatacacatgtcagtatacatgtagcgctaattctgcaggctcttggcagcatgcatgtggtgctaattctcaggtttgcagaaagcaagagttgtagaggattggcagcctccacccagatttctaaggatgtcatcaaaagcttgggggcccaggcagggacttgtcacagggggggttgccaccacaaagagtttccactagagcaatgctgtatgtaactgtagggtcagagctgctgcagagtccttaccagggtaatatctaatggagccatagaggcaggacctccaccaggatcccaaaactgtggagtcaccagtagcatgcaatgcccacgttggacagcttcagggaccagacttcagcacatagaagtagctgcatgggctacaccaagcaaagccacagggacaggactgcttgaggccttgggggcccaactcccaccccagtgtctcggaggctaaggtggagtcaaaggagattactctcaagctttacaattaatgtctgccctgctgggtttcagacttggttgggactagttaagcctttctttttgcctatttatcactttgaaaatagaaatctgtgagtctttctaggtaccttgaaagtagacaacccgttttgatttcacagactcacagatgagactgtggactttcgacttccgagttggtgtggggataagttaagactttggggttatggggatggattgcatatatttgtatgtgagaaggacatgagttttgggggccaggggcaaaagcctatgatatcaatgtttactccctctgaaactaatgttgaagcttaatccccaatgtggcagtattaagaggtggggcctttaaaggtgatttggtcatgagggcatagccctcacaatgggattaatccattcatggattcatgggttatcacagcagtggcatttgtggcttcgtaacaggagaaagagagaaatctcagcagcacactcagcccttcaccatgtgatggcctgggctgcctcaggactctgcaaagggtcctcaccagcaagaagaccttcaccagatgtggccccttgaccttggacttgttagcctccataacagtaagaaccatattccttttctttataaattacacatttctagaattctgttacaagcaacagaaagcagactaatacagacatggatatcctggggaagtgacagcattacgcagctgaccacacctcacaactagacagacaaggtaccactaacagaattcctttccttatggcagcactttggtctgtttttgctgatattttacaatgatgaaaatctgttattctctttggaagtactaaatttagggtaagtcagagaagtcagtttctaagaggaaaataatactcattcctaaatttcttgcccctaaatttctttcctcaagtctccaataagtgctgcacagctgaaatctcatatgtttttcaaaataattatggaacatctgccatatggtagatacagatgtgatcactggcttttgctttacaaatgcaaatgatgcctttgacgttctcattgcctctgtttgccaagaaggcagtgaaatgatgagaactccactctgtcacgtgagcacacatatgctaccccattacccaccacaagtctgagaaaacacccagggaaggaccactaaagccacctataggagtgactcaaattctgttaaagcaaaacacaaaatgttcatgaaagtgaaagagccatgataggtctgatcaatcgtgtgatgttttagtgctgcaacaccctctagtcactgatctcgggcccccagactcccccttctctttcgtctctcaggttaatgatttagaaaggtgacatatgtgtgattctattattgttaaaccttgtagttggttggtgagttaggaattactagaatctacagactttagtatatatagaatatactggcatttatgtatagaatctgtgggtaatgaactccaacttggatagatcagacaggaaggaaaagaggaagggaagaatggggaaaaaaaaaacacctttatacctgtgtctggaccgttgagtgttgttggggaaaatcccacagctgggaagatttgtgtcacaataaatttgccgtcaccagcctaaatggtccttcagtgtctctaaggagcatcccctctcctgctctacaaaatgaccatttctccttctctaacctactcaagcctcagactctttactctcaggacccagtcttctcttctgcttaataaagaaaggggggaaatagctaaaaatcctttaaaccacccctccatcagcaccaagtctgtaaacactccagggaccaatccactcttccctcacttaggttagaatggagacagtgacctgtgcagtacaaggccactccccaagtcctgtccacagggataggggaggcttcctggagctctgaatgtggatgtggccttgctgatggagtgtggttcagaatcaggggagcacagagtccatgcaccttcctttaaattgaagcacagaaggttgtttttccagaggatcacagaaattcaaaatgcacgctctgcaggatgctttggttgccttccgcattccaacctttccctgatgattatcctgttcctcctggacccttgttctttccattgccattgcctctccactgactctggtcatcatttaggtaggctcaagtcctcctttcccagcagggctctctctgctcctaccaccctctgcctgctagcccctatctcccctccccgttcccagcacaccttcctggagaagatgagagcccccacggtttcattttctcatttctcagccactttgcaactcaccctaacctgcctcctgccctgcccacttggttttcgactacttatctgttccttctcagtcttctttactcagtcatctgtctctgcacaatcctgaaatgttgacatttttatggattctgtcctaggccttctgtatctgttcatgctacctgtgctctttagagacctctactatatccattgctaaattcccatctataagtcaacattcccctccatctaggactatctactgagctccagacttaacttcccgctgctacattgtaccccacccaattgtattcagaggtgtttcaagctgaccatgatcacacctgcacttaagctttctccttccccacccccataattggtctaatgctaatgtttcctaaatcagtgaaaggcacgtccactcagctgtctgaacgagactcttctaatattcttgaattagctcacttccccccaactcctagggagctgtcatgacctcccaaatggccttctagaatccacccttgctcctctcaaatccaccctccagtctgctacttctcttcttataataatctgatcacacagatgactgcccagtgacttccaagtaaaccttaatcttaatatgagccaagtatctcttaaaatctggccactgccaactttcctagctctctcttgtatgtctatctctctttccccctctctgttttgtgagggttccttctgtttgttcattccccctccatcctgccttctggctcatgaggctgaccagtaatcatgacatcagtgagattccatgccctctgacttttggtgtgttcagggccacaggagtccagacaggagactggaaggcagtagaagagtaaactcagtaactcattcccttggctcactccccaatgaacctacttagcttgttccattggtcaaccaaagtttccttccccttccaggttctgggaattacgccatgaccccttgacccctccaggcctaaggatggtggcaagtccatcatcacacagccctataccatctagcctgttgtcctgacactcagcccataccatagtaaatggtccctttattaaacacaatgttttctttcttttcttttctttttttttttaatggagtcttgctctgtcacccaggctggagtgcagtggccccatctcggctcactgcaagctccacctcccgggttcatgccattctcctgcctcagcctcccgaatagctgggactagaggcacctgccaccacgcctagctaatttttttatattttagtagagacagggtttcaccatgttagccaggatggtctcgatctcctgaccttgtgatctgcccgcctcggcctcccaaagtgttgggattacagacatgagccaccgcacctggcctaaacacaatgttttctaagatgagcctgccatctgtttcctgctggggatttactgcgatacccctgcctgctacacctcagccctgctgggctcttctcagatccttcagcacatcatgatttactatccctggaagccttctcactatgaggctggcccttctttcctgcctggcccacaagctagattaagtccccactgtggccttccaaggtgcattctactttgctgttgatatgctgcagaatgctgccattattgacgtgattgctttactgtcagctccaccaagtggggagtcagatctgtggtgccccgattctcccagtgcctggcaccctgaagatgcaaaaaaaagtgtgttgaccaataagctcatttctgtgagtttacctgacagagatctgatgatattttaaagttccagtctagctcttgcaatacaaatatagagttgctacacaagcgtctttgaatgaccttgggtaaaaagtcacataatttatttccaaatcctagaggtactcaaaatccacccttcattttgacaattatgaggtctgaaaaaattgtgaatgctacaatatgtacaaatacattcaagggctgtgtttctattagtttcatcaccctaagaaattagtgtttccgtatgtttattgcggcactgttcacaatagcaaatacttggaaccaacccaaatgcccatcagtgatagactggataaagaaaatgtggcacatatacaccatggaatactatgcagccatataaaacgatgagttcatgtcctttgcagggacatggatgaagctggaaaccatcattctcagtaaactaacacaagaacagaaaaccaaacaccacatattctcactcacaggtggcagttgaacaatgagaacacatggacatggggaggggaacatcacacaccggggcctatcgggggtgaggggctaggggagggaaaacattaggagaaatacctaacgtagatgatgggttgatgggtgcagcaaaccaccatagcatgtgtatacctatgtaacaaatctgcacgttctgcacatgtatcccagaacttaaagtataatgaatcaatcaatcaatcaatcaatcaatcaatcaataagtgtttcataggagaaacgtaatataaggaaaaacataaatattttattaggggtttattattattgaactctgttgctggctgaccacgtaaccatatagtgtccaaattccatttctgtaaggaaaacatctatgtccttaaacttgggatccacacatggcttctcacacctgcatccttccaggtcagcctcttgaggctttggatggacactaaggaaccagttcctatgcctggacttttgattaccccttaactgccatcagccaaattgcaggttcatggtcctcctgccttcgcaggaggtggggcgggatgggggtggagggcgagggggaggacaggcttcctgtccactcctcttggaaagcttctatgcactccctagacctgttccctcctgatcagtgagtgcaatactcctagttcttcaccaacacactaagaaggaaaaagcctttattcatttatagcaactgacaatataaagacccaaaggtcataacaaaataaaaagaagccatctttcaagtgggacagagaagtaataaaagtgcagttagaaccagagagtggtcaagctctggcaggagacaagagaagagagaaaaagggaagagggttgggaagtggtgaaaagggccaaaagcctgaatttctatccaccttcttctcttatctgtccgaggggtatttttacatattatagcatgctattgtgaggtatattatagttcatgaaccacagtgacttttagctccatgttcactgtgtggcttttgttgtctatagtagaaactgtggtctgctgtccagattcctacttctgggcctaagtacacatctcctcatctgctgagtgtgttgtttgcaaagaattcagagctgagtccttctatgacctcaaccaaagacgcctcctccccaaagacatcactcatccaatgactggtcaatgggtgttgctggagcccaactcaatttgggacaagtctgaatgaccatccagcttcaatgttcctcaaagggtcagctattaaaattattgaagcaatgggggaattccactgtccttgtatcagtcaacatctctactcaccagaccacaagaagaccaagaggcccaaaaatgcccactgaagattgctgacaacatacagacccaaagttcacaaaaaaatgaaaagaagccatcttgcaagtagaacagagaagtgataaaagtgcagctagaaccacagagtggtcaagctctggcaggagatgaggagagagagaaaggtctttgagattctaagtaggccttgggttaatacaaccatcatttttttttttttttttgagacatagtctctctctgtgacccaggctgcagtgcagtggcatgatcacagcacactgcagcctcaatctcctgggctcaagtgttcctcttgcttcagcctccccagttgctgagactacaggtgcaccaccaccatacctacctaatttttttcactttttgtagagacaggatttcaccatgctgctcaggcaggtctcaaactctgggttcaaacaatcctcccaccttgccctcctaaagtgctgtgattacaggcatgtgccaccatgcccaggcccattctcataaagttgaagaagactttggagattacacatggacctgctattcagtgtgggctggaattaccccaaaggcaaacgccatttgcagatgagctgacactctctgctttgttaggtgacataaccctcctggaccatcagctccaggctccttaacctgcgcctagcatctaacttctaccccagagactatcctacatgctcaccactgacccattcccatggtcaatctgattgttcttgaacaatctttgatgcccctcttcattggattagacccttgtcctgactgttagggcaggacaggggtctcatccaatgagatgagaccagagcatccacctagctctggcctgttgggattgatagcagaagttccagggttccccaggtcagcacagccaccaccacgataaaggcaagagacaacagctgccaccatgtcccaggacagactggtagctcataagactggacaaggggccgtgtcttggtgtgagttctccagaagcagatcctaatttgaggaaaagccgatctataaagaaagtagacagaagctgttgactgggggtgggacttcaaagcagggatgggaagtgacttcaaataggcatgagagatattttgggggtagttctaaaagggcgattgttgtacaactctgtgaacttgttaagaatcagagaatcatacagttaaaataagtgaatcctacgttatgtaaattatcgctcaataaagatgttaaacatataagaatgcatttcagaagtaggtaagtggctaagaaactgagccttgtaaactgtcagcctagaccctgccctgccttggactgcacttgcttcacttggatctgggtcctctaggagacgtcatgcttctgtcaactggcattttcatctttgttatattcatagcaagtcccctgcctatggtgatcatttaacaattatttgctgaattgaactctagtgggcaggtgcatttcccaggacatcaaaaagatgctttaaagaaaggtttaacagaacgcttcctcccagatggcccttgcacgtgactcactcacaagcactaggaaaagggcgatgacgtggctgtgaaaatgagacaagacatttagctacagatccagcaagtcatcagtcttcaggagaaaaatattagcagtgcattgcaccattgcctcctgacttcaggcgagatggcagtgtcgctccagaaggaacagccgtccccaccacctgctgcccagtaaggccagaggcagcaggcccctctgttgaaactatgagattacagcccatgtggctgaacttgcagacaaagaagagggctggagctgcttttccttgtagtctaaatgttactgtgcatctccttgtggaacaacattgatcaaacatagccttcaccctgatccaaatctgcgattcaccctctcagaagttcctgaggagctagaacgttgcaccctcaggtctgtgcacaggaaggagtgtgtggtaatcttcagggggaagaaaattatcttagaagaatgtaaattgtttctactccagaaatttgctgaaaagggggagagaagtcatgtaaaaagagatgaatttattagaagttctccttaacccagtaggtcccgagtctgttcctggtgggtagtctggtaaaccaggaacacaagaaggttgggtagagtgtttaagcttttgagtcagagagatctgggtttggatcctggccccatcactaattagctgacccagctccaacctccctggatttcagttttctcgcttgtccagctgaggtaataatgaaaatttttgtagctggatgtggtggcacatgcctgtagtcccagctacccaagaggctaaggcaggaagattgcttgagcctgagagctcaagaccagtctgggaaacatagcaagaccctatctctacaaaataaaaattaaaaaactatccagacatggtggtgtgtgactgtactcccagctactcaggaggctgaggatggaggattgcttgagccttggagttcaaggctgcaatgaaccatgatagtgccactgtactccagcctggggaacagagcaagaccctgtctctaaaaaaaatgctatagttataaaaataattttttcacttggggtcattgtatgtttgcaatgagaggctacaccatgatggggacattgtataggagatactcagtgaagggctattgaaaccccagataggaatatttcattcagttaaattaatggaggccctggcacagactgtcattaaataatatgggaaggctcagtgtgtccctagtcagggtttctcacatcctttccagtgggcttctgccagagaagacagagagtccaatgtcatcactttcatgctacagcgtgcagagtcaaggagcaagaaacagagcctccatgtgatatttaaatacaaacagacttttcgagggtgttatatattagccagaacccccaaattagtatttgtggctctgcatttcaaacattaattcaaatgattgcttcctttttaagcttttacctgttgagattaaatcctgaattgactcagtcaagtacctgataacctaccaaatacttgatgcttgttgaattttaattgatttaattattcttacaagttcatcaacatgaattctggaaaagaaagtgtgttctaaagagttttaacgttcacccatcaatgggcgcacgtggagtcagattctttccaccagaaattgggaagggggccctggagcagcagaaccaggtggtccatgctggagaagcagataaaggcagtctgcaaagacagaacaaaggctgatgcagacagaaaggagaaatcctcatgggtaacctggaggctgagagagcagttaactcagctttgggtcactttccaggcctagcctttctttctcattttggttttttgagaaatctttatctcccacagaacctctctgtgggctgagccaggctgagtagattgcgttgaagacctatggggtcccatatgggataggcacctgggaccactggaagtcaactttggtgtctgttccggcctttctcacttcttagtgcctttaggttgtgattcactctcactatgttctccaattgaggcatccttgcttcagcaaaaagagaatatttcttcttcatctcccatcttcctggtattggagagtagaagagttagcttacaaggagataaacaatagatcaggagaaggcatagaggtttacagggaaaataccagtgagtaagtgaagagtgaagtattctttagatgtgaggaaacaggtaagggagagcaggaatataacagatataaccagagaaacagaattgaatcagaaaaatatagcaaatcaactgagagccagaaatcgttaccatctgacctcataaactgccacatctcaaatacccagtcttagcaagaatatgttctccccttccatgcagcaggtactcaggtcaatgacagcaccatcacaccagtgtctgaaggaagtcttcctagataacccagcacttatatcttcagcttgggagtccatgcattctactgtcacactgtgcccagcacgcagacagtgacccctgagccacagctctcatcaagaaatcacaccatggctcccaagacacctaaattcccttccattacctgtgctctctttttggatacatgtgaaccatgactacccacactctcacggtatggctatttgtgggccacagagggagaagatggaacttggttaggattactagctttagaagaaaccttgagagttcgaagtggatatgtccagacaattgaacatataggtctgaagctcaaagtacagtaggaaatagaaagttatgggcacacatttatcattctagaagatgatgtagaataaagatagaggagagccttggtttgaactttaaggaattcacttaaaggtcacgcacaacccagttgatacagagactagaaaaataaaagaaggagggagaaagtgggaagttggaagccaaagcaagagattgtttcagtaaagagattgtggtcaccagtgttggaaactgctgtgaggattgaaaattgcctgctaaattcaacaatacgtatgtcactggtgatcttggggtaaattgttttagtgaaaggaatggcagatggaaattcaccaggtgttgagtgagtataggcagggagataagtaaatgggtttcgacatgtcttcagagaactctggctttgaaatacgaggagaaatacaaaaagctcatgcgcataaaagtgcagcctaatatatcctaaagagtataatagagatgatgattgataacggcacaaatgaaacaccatttcattccataaaaggctagggaagagttgattggatttgaacccacatctctctgacctaaaaaccatggttgggcaagagaacctatgagaccacacatatgttgattaatctaaataactgtggtatatgaagacaggggtattatttgggtttgatttgttcttgtttctctagttccttgaggtctgacattagattgtctatttggcactttcaggctttgggatgtcagcatttaatatttaatgctgtgaacttccctcttagcactgcttttgctgtatctcagtggttttggcaagttgtgtcactattatcattcagttcaaagaatttttaaatttccgtcttgatttcattgttaacctaatgattattcaagagcagattatttgatttccatatatttgtatagttttgaggatttctttctttctttcttgttttttttttttttttggttgagatggagtctcgctctgtcacccaggctggagtgcagtggcgcaatctcagcttactgcaacctctgcctccccagttcaagcaattctctgcctcagcctcccgagtagctgggattacaggttcccgccaccacacccggctaatttttgtatttttagtagagacagggtttcaccaccttggccaggctggtcttgaactcctgacctagtgatccacccacctcggcctctcaaagtgctgggattacaggtatgagcccctgagcacagccagttttgacggtttcttttggagttaatttccagctttatgaggggtatgaggcaggctcgattccctgaatcttttggtctcttgcagttttccagtggtcatcaatgcagctggaattcactgttgcagccaagcaaccacataatacccaagaggaagcagaaagcaaaggcattaatataagcacatgtgaccaaaatgcaactggagcatactaaacaacagctttatttgtggcctccagcatgggctgggatgtgccaactgtgtaattctcctgcgcatgaagaaccgcagaaccatgcagactctctggctctgcacaggtccagttgcactttttgtaactcttttagtgacatttttcaatatttaatctcaagctaaaattcttaattgcttactattgttgttcattaaaaatgtaagaacaatctgtgtgaagtcccacaccttagcgtagtagagaaaggaccaaagtgagaagtgcaaaatctctcttgaaaagatgtgctgtgacaaaagaaatactgcttctttctaagttacatctaatagctattttaaatgctcacataaacacaaggattgatgaggaagggagctgtctgtctctaccgtggtgatgctaaaggcttagcagcaacattgacaaatacatagatcattgttgtcaaggggttttagttaatcatgaagaagagcgggaaaaggatataatggaaaacgaagatgagacgttgacctgcagatgtgattgacttggaaccacaccctgacaattgcagaggcagaaataaaaacactgggaccaaccacaagaggcaagtaggtaatccagttaacaggaggaagagcaggtaactgaaatgtcaggagctttatgtactgaccttcgattacctcacggtaaaggaaaatattgaaaaggccattgatcttgtattcttattcatgaaaaacagcaattagcgaggtgattgcagtgtttgaaaatgtgatagcaatttacaagttcaaaataaaaacaagtgaagaaaagcccttgagaagggccacacatcaaattttctaagcatgatttgatctgcttcagaaagaagatgctgaaatgctgcagcccagtgatgcaggcagtgacagctgacagggtaggggctgaatggagaggagaagtcattctcaaccttcaggtcattgccattttgttagttccagttcccaaagaaaaaaggtaaccccaatctaaagagtgtttgtacatgatgaagggcctatcacttggtcattttctcagaacaaataggaagggacagactgccacgagataaggctattttccccctaaacaaagctcatttgtttccaccagcagcctccatccctaagccctcaacctgggctgacacagataatgccttaaaggcaggctgcccctcacacagacacaagaacctagtcagcaaatataagcaaatgtaggtccctttgtctcccaggataaagctggcaccaaccctctgctggacaaattaaaagacaaaattttccaccactaatcaaatctcttccatgtaatgagcaccactgtcttctagggcaactgtgattacgtccgttttccagatgaaatgctgagaaagtgataataatggaagtgtcacacacacccagggtgtgcttccttgttttcaaagtatttttcctaagttatggccgtttgctttgttgtttacgataattttgtgaggtagacaggatgggagatatgagtttagggatttaggttatcatactgttcctgaagtcaggtgatctgcattcaaactgaacacacacctctagtgaccttcagcaatgttctcaacctttctgtgattcagtttgctcatctgtaaaggggagagaggactacagtgagactgagatgtgatgatgaaagatcctacacagtgcctggcatttagaaagtgctcagtagtttgcagccatcatgattccacctgtcaccattgtggttgtcaccacagatgaggcaatgtggctgacatccctgagatcccaaagtcagagaggcaaccacaggcagaatccacagttcctgcttccaatctattatcccttcccgtctactagagaaacaatgtcaaaacagcaaaatcagtttctaaaaagtggggataacatattcaatgtgttttttaaataaatgaaagtcaaagtgctataagtgctgtacaaacgagaagaagtgtgatttgaagcttgagcaaaggctcagaaagggtcctaatttgtccttagttctgtcctgcaccatgtgatgatgaatttgaggtgtcgggatgctagatgcccttcctacccccaaataaaaagagggggtgaccttgggaggccaaagcaggctgatcacgaggtcaggagttcgagaccagcctggccaatatggtgacaccccatctctactaaaaatacaaaaattagccaggtgtggtggcatgcacctgtagtcccacctactcgggaggctgaggcagaattgcttgaactcaggaggcagagcttccagcgagccgagattgcaccactgcactccagcctgggcaacaagagcgagactctgtctcaataaaaacaacaacaaaaaccaggggtggttgatcctctgcatcaaaagatacaataacaggaggaaagactggtgctgcgatctgcaatagagatctttcacatcctcccaggaactgaagtcctagcccaaggggatacattttttttcttattaagcaacgctgctgggttgtcttcaaaatgaatctattttctgttgagtcttgagactatatgcccatatttattttttagagacccaaataatatttctaaaggtctcaatagactaaagtttccccaaaataaagctagaatacacctatgagaaaaagaaaaaaaaaattctacacatggcttcgagctcgctcttttttgacattctctaaagctgatgatgaactttggaggtgaatttcatagcctttaaaatcacgccattcacctcttcaataggtaaggattgaattctcattcagccaaataatgggttattcttatttaaagatatgcagtaaattagattcttttttttttttggtgccaacaattaggaatacatacttcctgtttctaagcaatttcaggtttaattaggattctctaagccccatttgtcttaacaatttgacagctccggcttccccttccacacccacacttttcctttttttacactctcccccgtttgtagtattttattccacataaatgccaggagggaaagggaagcaagcttaagtgcaaatcagatcgcttgtttcttctctggaacaggccactttcaaggcacctatgataaaaggttattttcccttgactgacaattatctctaagctaattattaaagtgtcttattaaaatgtgcatgtctgggggacttccaagggaagcaggatgaaatcccctggaagaagaatatgacatcacaggagtaatgtgcaggagagcgccctgtttgtccatttaaattagtttcatcatccataacaagtgtttaaaaagcagaaaagcaagcgtgatgcataatgcattgtgccatgatgcataataattaggcctgctccccgccaccccgtctcccaagacttaaaaatctctccgagtaagcattttgttctcaaggctttgacaaaaatgccatttagggactttcaaatttacagctaggcaatttgtcatcatttatatgacagagtagaaggtaaaaggaatataacactgcgtggttcatcacttcaagaagctcccggtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaagaagctcccggtgatgaaagctccttgggcctcgatgtggtaaagggacatccgcctgtccctgcaacactgcctggatggaggcaccccgcccccatgcgatgtgttgttttctttttaaaaaaaagacaaagtcggccgggtgcagtggctcacgcctgtaatcccagcactttgggaggccgaggcgggtggatcacgaggtcaggagaatgagaccatcctggctaacatggtgaaaccccatgtgtactaaaaatacaaaaaattagctgggtgtggtggcgggcgcctgtagtcccagctacccaggaggctgaggcaggagaatggcctgaacccgggaggtggagcttgcagtgagccaagatcgcaccactgcactccagcctgggctacacagccagactccgtctcacaaaaaaaaaaaaaaaaaaaaaaaaaaaaaaaaaaaaagacaaagtcacataagatagttatcccacgcttgagcatttgctcttggaaagccaacgttaactgaaggtttagaaatcaatcttcagcttcatatatgttgcttcttctccaaccctccatggacactgaggttaagaacagaacaattaaaaatattctttactctaaaatagcattttttgaagatgtgataaaatctaagagaacgactaaatttagataatgtctaaaacacagctgaaccaaaaaaggaaagagatggtctttggaatgagacattgttactttaaaataaccacataattattttatataaaaagagctttttctggctttaaaataaaatttagatctgaagtacaaatgtagcatttcctgttgaagtatgacaggaaaccaggatttgaggtctaataagccctacacggagcccatttgcgtaacagccatccacccatttgctcaacactgactgagcacctaaggtaggctggattcttcactggggcccagggctatttgcccaagaaaatctaactgaggaaaaacacggaacacaaagctgattattttaggactggttagaaagggttaatataaatgatttaatgattgaatgattaatggagtccaaaaggcagactcaagtgaccagaaaaattctctttcagctaatttaacattttaccgtaattgaacacagattgcctcaaaccacagcactgtgctgggctgcacccaggcaggggagcttttcagccccatgtgaaccttccccagacagtgggggcagtctatgtcgtcaaaacacattattggattttcaccctataagatgttgagtctcaggaaacaacaagggccaaacacataatggttgtgtatacgttcccaattgcatacttagcattcactgagccataaatttaggaacataatgctaatgccatataattactaatcctcacaaattttgagtgtaaaaaaggcccatctcagtcaaccaacgagatcattgtgggccaagctgttgtgataaatcacgcaatctagcatggatatattgatctgcattggcttatatgcgaatttctaatttcttccaacattcttctcatgaatatgtttgccatgatggaaactgtctagagctgggagataggccagcttggtttgggttccagctccattccactcatattgtgcctcattaaagaagtcaatttacatctttgatcctcactcccctcttatctttcaaatagaagattttgacaggtaattaacaaaggtccttccatgtctaactgttgatggttctagggctctagggccttaattcccaagaacaggatatcatcatcaggaatgggataaggcaggaagttgacaatttatggagaaaaataatgtgtgtagggatatataaataaaggccccctgcttgtgactaaaaaaagctagaactataaaaagctcttaggtaaaaaattggggtcatgcccagcaatcccattacggggtatatacccagagggttataaatcattctactataaagacacatgcacacatatgtttattacagcactatatataatagcaaagacttggaaacaacccaaatgcccatcaatgataaactagataaagaaaatgtggcacagatataccatggaatactatgcagccataaaaaagaatgagatcatgtcctttgcagggacatggatgaagctggaagccatcactctcagcaaactaacccaggaacagaaaaccaaacactgcatgttctcactcgtaagtggaagttgaacaatgagaacacatggacacaaggaggggaacgtcacacaccagggcctgtcagggagtgggggcaaggtgggggagagcattaggacaaatacctaatgcatatggggcttacaacctagatgacaggttgataagtgcagcaaaccaccatggcacatgtatacctctgtaacaaacctgcacattctgcacaggtatcccagaactgaaagtaaaataaaatttttttaaattagggtcataaatatgtattacagaaaaaaattatcttatggttgaactccatagccatgtaaaaattcaaagaaaaaaacaaaaaatcaagagtgagtgaatttggataaatcacccagtgtggccctgagcctaactccattcaagatttatgcccacttaaacatcagaacctcccaggtttcaatgttaaccttaatttcctcattaagcaataacttctctagagcacaataatagattataatttattatgcttttaacttagtaaattgccttaaaatatattatcaataatttagtacagcaagttttttgtacccaaaccagatatccagacatatatatatatgtatgaactgtagttggggagggcttcgcagatatatatatatcttcacatatatatagatatatatatcttcacatatagatcttcacatatatagagagatatatatatcttcacatatatatagatatatatatcttcacatatatatatatacacactctaatttcttgaatcatcttcactgttttgagtttgtcaaattgtcttttttgacttttcacaacttaagagtcagtacatttttcattttatcttttagctctgttgcacacagctttgctctgagagtccttaaaagcttctcactgcagcctggattttgctcttcagcctccttcagatccattcagtctctagatttatgtgcatgcatgcacacacacagacacacgcgcgcacacacacacacacacacacacaccccacagcagtgctttcaatgcctagccctcttctcaaactgcaggacagcactgatccatgttccctaggattctgtggcaacagcttcacttccataaagccctcccgaagtacagttcacaaagcttcctttctcctctatgtttatatttaacatttttagctgcatccatgtccctgaaaaggatatgatcttgttcctttttatggctgcatagtattccgtggtatatatataccacatttttctttatcttgtctattattggtgggcatttaggttggttccatgtctttggagctggaggccattatccttagcaaactagtgcaggaacagaaaaccaaatacctactacgtgtcatcacttataaatgggagctaaatgatgagaacacatgggcacatagagaggaacaacacacactggggcctattgaagggtggaaagtgggaggagggagaggatcaggaaaaataactaacgtgtactaggcttaatacctggatgatgaaataatctgtacaacaaacctccatgacacaagtttatccatgtaacaaatctgcgcatgtatccccgaacttaaaataaaagttaaaaaaaaaaaaaaagaccgggcacagtggctcatgcctgtaatcccagcactttgggaggctgaggcaggcagatcacttgaggtcgggagtttgagaccagcctggccaacatggtgaaaccccgtctctactaaaagtacaaaaattagctgggcatggtagaacatgcctgtagtcccagctactcgggaggctgaggtgggagaatcacttgaacccgggaagcaggggttgcagcgagccaagattgcaccactgcactccagcctgggtgacagagtgagatcttttctcaaaaaaaaaaaaaaaaaaaaaaaaaaaagtctttttagaatgatcaggagctcattttataatctaactaaattggattattcagtttgtctccttgttttattagcttatattacctctgtttttttttaaaaaaaaagactttgttactttgtacttatctatgtcataatttcctaatgaaatggccaactaagaaaccatatttatactgtgcttatcttattccatattcccaatggacataaaataagcacagtaaatattttcaggttaatgaatgctctccttctaagaaagcccattggtgagtttacactggtttcatcttcggtcattaataacattagtaacattctgtatcatgatcaccctgcttagatagtgccagttcctcacaatctgtatcacgttgagatgggtatatacaatatgtaaaccctacttctctttattttcagtttttcaataagtacaaaactataactttttcaataagtacaaaagcaaagaatttacacataaacttcttataagaaataacacttcggcctggctcagtggctcatgcctgcaatctcagcactttgggaggccgaggcgggcggatcacttgaggtcaagagttggagaccagcttgacccacatggcgaaaccccgtctctactaaaaatacaaaaattagccgggcttggtggttcatgcttgtaattccagcggcttgggaggctgagacaggagaattgcttgaacccgggaggcagaagttgccgtgagccgaaattgtgccactgcactccagccagggtgacaaagcgagacaccagccccccagcaccgcccccccaaaaaagaaagaatgcttaatcttagcatacatacattgtgtgtgtgtgtgtgtgtgtgtgtcaataagtgtgcaagatgaggagagaaaggaagacagacaaggaggccaaaaacagataaaccataaaaaaaaaccattaagctgctcaacgaaaaagtgaggctgcagatgtgaaatatgaaatgaattgtaaattattttgaggtcaaagttacactaagttgaatcctgtaaatctcaattcaacttgtttaaggctttcaaaactcacaacgtggaacacatttttaaacttaaaatttttcaggatatgaatgagggaaaatggatatttgggtgataccaagttatactacataacaaaaaatataaatatttataggtgtgcttaacccttcattttctggttactaaaaacccaaatagctttatgctaacaggaaccaaaattgatcccaatgatttgtaaaataatagatggtgattgctacagtgaaacctcacccaaattcactgtcaatactacatttttgtatactttaatttcaagagaaatacaaaaaacagaagaaattaaacttgtcagttatgagttgattgaagctgattagcccttcaggatgtgccctctgatccatacatattgcaatgcagtcaggtttcagcatctcttgggttatgctgtgataaaattatagaataattctcatcaggtgttataaaatccctgtcaatgactccattctggcacatagtttgcagaaacgcaaatttcacagagtctcaaaagaaaaaaaaaaagtaggcaatattggcagtaattaaacacacaaggctataaaatctatccacagctttagtttaacggtaaactcacattgtgagacaccgccatggggataatctagacccaaccttatcagcagtcatgcttggatcatccccattgggctccctctgtcccccagcctcccacctaggtcagtacccagccgccatcactgtcctagtggcagatcatctcaccccggcaccgtggaattagcctttgcttggccacccttccaccaattctctctgctctccaatgtctcttatgtgcggcaaccaaaatactgcattgattgctcaaatagagatgagcattttaacacacgaatcttcaattcaattccatctaaatttgaattcaaatctttccacaatctgctccctatcccatttttattattgatttttttttttttttttggagacagaagctggcctcacttctgtcacccaggctggagtgcagtggcacaaacatggttttctgcaacctcaaccttccaggctcaagcaattctcccacctcagcctcctcagtagctgggaccacaagcgcaggccaccatccccagcttactttttaaaaaatatttttgtagagattgggtctcaccacgttttccaggctggtttcaaactcctgggctcaagcaatcttcctgccttggccccgtcaaagtgctgggattacaggcaccacctcgcccggcccctatcccatttttagatgtgtcttccaccatgactttgcacagcagcttgatagaattctgtgtctctccctccacacccggggacttccctcattttcctcttttctcctgccaatcttttcactgcccacgtttcccagtcaaaagcatacacaaccttaaaagtaaagtttttaaatccccctctctttgaagccctttttaaataggctaatcagaagttgttttctgcttccataaacactgcagagctttctctgtatgtccgacatggtggtcattattgggtacacccttttagaagctgtgagcatgtcctattgtcctggagactttgccatgacccagaaaagaggaagttgttttgtttcttgcacagtcgttaatatagtgtttttttctcatttatttattcaacaaatatggagggagcaacttacgtgtcagtccttgttctaagaactgaagatactacaatgggcaacacaaaatccctgctttcttggatgttacagtttagtgcatataggtgttcagtgaacattttctttctttccttccttccttccttccttccttccttccttccttccttccttcctttttttcttcctttctttctgagatggagtctcgctctgttgcccaggctggagtgcaatggcacgatctcagctcactgcaacctctgcctcccgggttcaagtgattctcctgcctcagcttcccgagtagctggaattacaggcacttaccaccacgcccggctaatttttgtatttttagtagagacggggtttcaccatgctggccaggctggtcttgaactccccaccttaggcaatctgcccacctcagcctcccaaaatgctgggttacaggcatgagccaccgtgcctggcctcagtaaacattttcaaaaatttttgaaccaaatatctttgtattcctcaaagtatatacaacatatcagaaattacatgggtagtcaacaaagattttttttttaagtaaggggttttattgttatatcttttatgggtgcgtgagagttgagaattctagggcataatgcttgttgatcttttaattaaaatacaagtgcagatcttccaaatgcagaaactattgtcacacagagatatactgtcattccatcagaaatataaataaataaagtagaactgaagagacagcaatgacatccagtccctaagagctatacattgctttaaacaacattcattggtttaattattcaatcagtaactacttactgggcacctgcagcctgttagtcactcttctaggtgagcacagtagacaaatgtgggcttccccagttgggagagacagatgataaacttctaagtatatgattttaagtactctgacttccacaaagaaacctgaagcatggcaaggagaaactgaacaatcaaggaggccactttgttttagatcaggtggtcagggagacctctcttaggtggtgatatttggacagagaactgaaagaagtgaagaagtggggcgggaaaaggccagggtagagcattccaggcagaacacgcggccagtgcagtgctgaggagaggaccagctcagcaagctgtagaaacatccaggtggccagcatggctctgtggagggggtggggtgggccagcccaagccaggccatggaaggggtttgaggtgtaggcaatgctgtgtttattttggggatgaagggagaggctttggaaagaggagtgatgtaatctgctttatattttgaggaaatcccttggctactgggtggaaattcagctgtgagttggcagattatcatgatagtccaggcaaaaaggagaacgcagcttgaaggaatttaaaggtagaagaaatggtcagattcttaaagtagcatcactaggacatgctggtggtttgaatacaagatgtgaaggacagagaggaatcaaggacgactctgagatttctgttctgtgcagtgagggacgagcgatgctcagtttgaatgaccaaaatgtgagatagaagtggttacagggaggaaaatccagaaggcctccttcagagagtttaaatgttgagatacctgtgagttttgtaaagggatgttgagtaggcagctggatttcaggatctggatttgagctcagagaagaaatcatggatagagatacgaatatggaagtcatcagcatagagagggcatttaatgccttgacctaaattaaattatatagagaggaattagagagaggaagggaagggaaaggaagcagagaggaaaggagaggagaagagaggggtaagaattaatccctggagtgggctgcaacatttagagtctaattagagggaagaagctcaccaaagacactgagaaggagaagccagtgaggcagagggaaacccagagagtgaggtgtgcacggtccaggtgaaggtgtttcaggaagggaagtgtgatctgttgtgtcacagctgctgagagagtgaacatgaggaaatctagaaacgtggcccatgtgtggtggctcatgcctgcaatcttagcacataaagagacccccatctctgcaaaaaaattaaaaattagctggacgtggtggtgcagcacctgtagtccagctactcaggaggctgaggtgggaggatcactcgagcccaggagtttgaggccatggtgaactgtgattgtgccactgcatgccagcctaggccacagagtcagtccatgtctcaaaaaaaaaaaaaaaaaagaaaagaaagaaagaaaataaacagaaaaagaagactagaaatgtggaagtcatcagcctcattgacaaaagcagattcaatggagtggtgaagaagacctgatcagtgtgtgttcaacagagactgaaagatgagagtgtcaggtgagttgaaacagcgctaatcgaagtgtgtacagaccagctgcttgtttcttgtctacagtgagacaagcacagaaactgagaagttgctgcaacattcaagggggtgatcagtgggctccattctcaggaagggcggtacaggcaactttgtgtatcgttcaactcatgtgataagaagcatgagcaacaagctgtgtttgaggcaagtactgtaaggacctcacatcaagctgcaacagattggaaaatgaaaaactgatctttcagcacagttagtttgagaagcactagtatactcaattctttccagtagttttactattaaaaagtatcagaggaattggatggaagaaggaagtggtgacaagatgggaggtggtggttgttagtacgttttacagtggtagggataacagagagaaaacagaatgttgatatgctgagctggaagagggggaagttgaggctgagataaaatgcaagggcaggactgatgcagtggctcacacctgtatttgcagcactttgggaggctgaggcggggggactgtttgagcccaggagttcaagaccagcccaggcaacatagtgagaccctgtttctataaaaataaataaataaaaataaatacaagggcaaagtctttaagcagatgggagatgtggaattctggacatgaatggaggtttcagctttcaacaggagcaaggccagggcttccatggtcacagtagcgaaggtcatgtgtatgggtctggtgtgggacctgagattaaggttccatattgtgttgctgtgaacgggataaattcagaagagcctcaaagggcttacctgctagttctcccccacccatgagctgtcatggataaagtcccctagccaaatggcactccgctcatagggaccaggcacagtgcctgcttacccatgagtagtgggcttcggtctcccgtcagcctgtggaatcagccaaataagccaatcacatcctccctcaggaaccaggggacaccccaccctctttttttttttttttttgagacagtctcactctgtcacccaggctggggtgcagtggcacaatctcagctcactgcaacctccgccttctgagctcaagtgattctccagcctcagcctcccaagtagctgggactacaggcacatgccaccacacctagctaatttttgtagttttttagtatagatggggtttcaccatgttggccaggctggtctcaaactcctgacctcaggtgatccacccgcctcggcctcctgaagtgctgggattacaggtgtgcacacacggccaccatcccttcttgttactacaaggtctgcttcccgcagcccctgctagttcactctgtatggcctgccctgtcctactcccctgggctgtgggaatacttgaatgcaacactgctgtcaattttatctgcccagggtcatgtgttcaaccacccctataactgaatcccccatcatcagtggggtgaaagggaggcaataaaaacaggagtggacgctgatcacatgaaaaattgagtgtgtgggtgtgtattggagagcagggaatagtccaagtattcacttgattcttcggttttctcagtaaatcatatgaggttatcgactcagagtctgggaaaggaaggggagtttgaggtttggggaggtgagaaaggtgtgaagtagtcttcccacagacacagaaatcaactagggcagtgaggtagattgagggcagagctaagagcccactcgaggtttgtggtcatgcataatgagaccagtcagagcacagtgtgtgcagcgagagctccttggtcaagtgcagctgctctgatgcaatggcagataggctggggctgtataatcaggtatatcacaaagtctatagtctctgagacatgggtgagtaggtgtgagcacctggtgaaacaggtcagaggaaaagcaagttggcgttggagtcagctgtcaagagatagatccgtgatggtatcgagatcactacagacaggtggtggtcacctagtgttgtctgctgaaatttggagggtttaatttttaatccaaataccatagaaatggatatgaaaagatgggtgacacatgctgcacgttgggaagtggggatgaccaggtgcttagttgcatgggagaggccacaagtgcttggcaatgttttcgtgactgagcctctcatctcaggaatgagctgagattccagaaatgctgggatgaaaacaaaccaaccctgagactcccaaattgttctcatattgccacattttttcccacatcttccttcagaaaagcttaagaaagccatgtttgctatctggctcctcttaactctccccataacttacatttccagttttccagataagcatggccatttgtgttaggtcattcttgcattgctataaagaaataccagagactgggtaatttataaagaaaggcggtttcattggctcacagttctgcaggctttacaggaagcctggtgctggcatctactcagcttctaagaaagcctcaagaagcttacactcatgaaggaaggtgagaggggagtaggcaggtcatagggtgaaagcaggaacaagagagacagggagtaggtgggggaggtgccacacacttttagatgaccagatcttaagagaactccctatcatgaagcacagcgccacgccatgaaggatccctcctaatggatggcgccaagccgtgatccaaacgtctcccaccaggccccacctccagcactgggaattacaactggacatgagatttgggcagggaaaaatatccaagctatatcaccactctaaatagtatgtgcactcagaaaccagctgacctatctggggctcattcatccaggaagacagcctggaagtcaagtgcaggagttctggaattagactgcccgggttcaaatcctgcttccaccccggctcaatgtatgccttctctaggaaaggcattcacctttgtaagtcttgaatttccgcaagtgtaaagtggaaataataccaacaggcacctcaaagacttgtttgtcaattaaatgggatggtagaaaaaagcacttagcacagtttctggcacacaataagagctcaatgaatattagcaattactataaacaggttcattcaccactccataaacaggtgattctgtcagtattaccatagtatgaaattcaggctgcttaggccacagacaagaagacaaatatctttaaatttctctgtagtcagactctccatgggatccctggccaaggtttgtgaggtggctgattggacaggatgaaggcaattgtcacgacaggggaccaaccagtggacccagatggtgacttcattagaacagtattccaaccagcaccacgcagtgtgtatcctgcagaggggccaaccaggcaataaaccgagttccaccaccttgcagccagcagccgagggaagctctgagctctgagagaactggtctattttcatcacatttggacaatggacacactccacagaaggcaaatgtcctttctcagaagacatatatcacatatgagtagctggcttgaaccttaactcagtgtgagagagtaataagaatatcaccatagcgtggcacaggtatgcacacacacacaggcacacacaggcatagcttattcttatttattacaagagctttcagtcaggctgaaatgtctaggcagtattttctaaactctttaagacgcatgtcccatggacacttccggtaaaatgattcagcttcaataagattcagacgcttactaacaaaactaatttgggtgttttttcagaaaagctcaaactgatacaaaactcacaatttcagcctccaattagcaatttcaaaaatattttgattctgatattttggcattgagaaaattggtagtcagttcaggacaaatgaaatagagtgtacttaaaaacagatgcatgatttaaatttgagagttggggaaagattctatcctgtaatatgaatgtaatataactgtcatctggtctccaattttactcttcccaacagaatgcaatctcatgaaatagttgcacctctgaagtgggtaagagttaattaacctgtctcttacttatctaacttaagtaagcgaaatggctgacatggaaaagtaaatgaattttccatttatacaccgatttttaaaaaccgatctttcactttcccaaaacaactctttaaagaaaatttaacataatcattttcagcttgaaaacttcaaatgaatgaatgtggcttgatttgggagaagatttaaagactgtgacaccagacaacctgggctcaaagtgctattctcaaatcacagttgccacctgaccagggcctgatagtcaacatttccaaaccctggttttgcaatctgtaaaactgaaattaaaaatacccatttgactgagaatgaacagaggcgtagtcctcagtctgtcattcaacaattgtgtgaccatgagcacattgtctaaccatgccttctttacgatggtcataataacaatattcacatctagtaataaatcataaattcaagctattgtttttatgatcattactattgtagctaataaacataacgagtgcgaatcaaatggtcactcaagtgtccacacactttagatgcccaatacatacgagtttccttttaccctcattcttttttagggaaataattacaaggaggatatctttcttcaaagcaaaccaagagattttcatttctatgaaggagattacacaatattcgaaggggtatgtgacaatctatgcagataattactctctctatgagtaattcttgtggcccaggggttcttaggatgcgggaagctggaatggtaatatatggtatcatcgtgtgacctgctcttgaacgcaagaggctatcgtttccagccagatcaaaacacaggcaaattctgatttaaaaaactgcacatattctacatgctcttatttcttgtatccagactaccccattaagctaatataaagggagaaaaagtgatagggtgcaaggaaaaattcaatcactgctaagctcatcaaactacacaatgagccatggtaatctgcagccttagagaagaagcccatcaatgacaacaccaccatcgatattttctactcacattctttcctatgcagtcccaattttcttacattaggaagcatttcatcaacattttaagttaacgaacctcacctcaaaaaatcacccagtctaaagtacacggcatgcaagagcaaacctaaactgtgttatcagaaaacaaaaccagatgatgtcgtgcctttttaaggaaatataaacctaaaataaaccgagaacacccctcccggggccatcacatacacaagaggcagagacttaggcaacactcagaagggaaaggaaggcaaacagcgaaaagtctctcagagaaaaagatttcatggactttggagccactacagctgtctctgcactctcctcttcaagcgtttctccacatctagtatcttcaaatcattagtgctttctagctacggtttcaatatttcccagaggtctctccagtccagcctttgcctgagagaacaggttacaaaaatatcccctctcccttttaccaggcaacaaagagaatttgcagtgctttgaaaacagaaatccacatccacaggaaaaacaggcctccgccagccgcagaaaagggtgcttcaggcacagggcaaccaggcgagagaaaatgcattcagagcggttagcacacaggattaatcacattataatttaatcatctgatcaaacactaattagcataattgcttgagggagaaatggctggaggaacccaggaacaccctgagcatccatgttcttaatgacaaaagagggaacacagatttggcttccctttcttcataagaaaagaaagaaaatagcaaataaagttaatcaatgacaagcatcaccagctatggttttagcagccaaaggaattgcaactgagattcatgacattttccttcctcctctctctccaggaccactctaaaatccatggaaaaaacgcagtactgatgttacggtaactagactctgagctatttaagtctgtgttctcaaccttggcacaatgaagatgttgaactggatcattctttgtcgtggggagctgtcctgtgcattacagggtgttgagcatcttatagtgagtgtcccctccagatgccagtagcaacccccaaccagatgtgtgacaaccaaaaatgtctccagacattgctcactgtcctctgtgggtgcaaaattgccctccgttaagaaccactgaagaacacagcttgtccggtgcatacttcttttaaaagtaaccaagtcataaaaataggggaggagtctttttatttccatttgccaaaaaataatgagcctaaaataatagttgcccagtttgggaggccgaggcgggcggatcacgaggtcaggagatcaagaccatcctggctaacatggtgaaaccccgtctctactaaaaatacaaaaattagccgggcatggtggcgggtgcctgtagtcccagctactcgccaggctgaggcaggagaacggcatgaacccgggaggctgagcttgcagtgagcagagatcacgccactgcactccagcctgggcgacagagtgagactctgtctccaaaataataataataataaaataataataataataataataataataataataataataatagttgcccagttccatggatttaccttatttctcatggctctatttagagctttacaataacccataatgcctatgcctgtgcacttcagaaaaaaataattaaataccagcctcctccatcaaagacctttagggagacacttccaggagcacctttgaatagggacactcacaggctcagagaactccaacccttgcttctagacttcagtgtgccctgagcaggcaagaggtcacagcaatgtcttccacctacccaggagagagcaaaccaccagtgactttgaaaatgaataaacccagagaaggcctccagaccccccaggaaaatacagctttctccctccactctcactgagcacatgtaagctctaatatttgctcccagtttctaaagagggagagagaaaggtgaacaagatggagagaggtgaaatgccgactgctcctccatttcttgcaaatgtatctccaccacaatcgactcattgcataaacttaacctgccttggccaccagtcaggctggacctaacaatattcactcttatcaagagatgctagagaccccagggaaaaatactcaacacttattgctgcaggaaagaaatattttctatgggttaaggtgatttgttctaataataatactgagtcacattatctctcatttttattttttttatgaagaaagtgtttcaccatttacaattactcatgagtctaacacaggttattaaatctgatgatggaaatatttatgccctttccgtggcagaaagatgggaaaagattgacctactctactacaaaatttaaaagagaacagtctgtgctataccatgtaggttgtgaaaactccaaatcagagaggaactgtgagctattttaaactgaaatcttcttctgcaattcccctgtcagagcttgtgacttcttaatataatgcccccacccccttttaaaggaacatgagtataggaaactattattgtaaagagacagtctaccctaattcctgtagtgatgagtaagcagaattcacatttattcagcctacaatggcttttataccatttccttctaaagctaaatttcaaaacggccactcaaaaaggtaatttctatagtgaatcacaataaaatcaccaaaggattataacatcaaacttgtttaagatgcctaggagggaaagttatttttaatattatctaaaataagatctcaggacacaaaaaggtatttttaaggttctgaatttaggcctctctccagcacacatttgagtctattttagtgccaaaatcaaggacacgatgttttgaaaaaattaatctgccaccaataactgccctctattttgtcatatatgtaacaaggtttaaaatgcacatatgcccttatatgccagcttctctcttttttctgacaacttaggataatgacatatactttgtatggtaaatacagtcaacttgtgattatttacctaaaagaaagccaagaacatccaacagagcaaatgacccaaagcccttcagatctggctctggaatgagcttgtgccctggacaaaggaatgtgcagcatcccaaggcggcatcaaagcaaaacctctagctgcaaacagatccactctcctgccctgtctcagcccgttctagctcatctcttaagcttgttcagtagagttacccaaatggtttcccactatggatctcttgcctggagcttcatggttacaggcaggtttcaaagggcttctctgctgggactccagctgctatcgaagaagggaccaatgtgagaaatacaatggaatcaagaccataagcaaagcacaagcatttataaacctgaatatcaaatacgctaacaggaagaaaaaatggtgcaaagagatagatattaatacacacagatgattcgtaagctgctagcatccacattgggagtgcctctggcaggatctacatacccctctactcagaatctttcttgttactaaaccccagcaccaattatcccgaaagatgcccaaattcttatggtggtcagtgaagacctaaccctgtatacagacattcccaataaattactacccaatacagagttctccaacagttcatcgagatgtacttggaactttactggatcaacttcctagctactgtttgggtagcttctttgcaagtgtgtgttttgcaaaggtgaattatggttcatgtggatcagaacaggcaaaggcatgcgttaataatgcaaattcacaggtcgtgcatacaccaaggctacagaatcagactctctggtatcagagctggaagacgacataacaaacatggaaaccataacttgggagaccccagtggtggtgggaaaaacaagacaaagtcacatgggattagaaacacctggggagctttccaaactacagcccattccccacaacgctggcatcagaatttccaacaggaggctaatgagaggaaatgcatttcaggaaacttccatatctcctttctctgttctccctgacccagaacaccggggtgttgagaaccagtgtcctcgatccttacctgggaaggcccacatagaaggatactaactaatgttcagcttgaagtgtcaacagactgtggtctacctcttatcctgatgtaagggtggaggggatgtgtggctatggggctggcacagcctcttcctccatattcagtgttcccatgaacatttgcctccgctgcctccaagcatctaatcccacagaagcctacagcatattctatattcttactctcccatcctcagcaatggggcggtagaggtatgggggagagtgtggggcccctcgtgcctgtgattaataaaggctgatgatgtgagatcccccaagacacaaataaaccaaccactgatgagagttccttgcccaaaacaaatacctagatcacctcgaggtccacatttttctacccagatttctatacaaatattcaatgaagcctattctaaaacagtagccaccaaggatttaatagctattgatttgggtgagtcataacagacacatctggtaattaaccatcctacccacattctgctgtcacgttaaggacccggatagaggttgctaacttgggctgccaacttaaacaacttgtgaaaggaggattctgtctgttagacagcattccacatttcttgtgcatttccttttcactagccaacgaaatagacaagtgactagcctttgcaggaactgacaagaactagatccggcaggagtgataaagtagtcatggttcccgttttgctggtagaggccattgttgtcattgttgggtgtcttcagctcattcctaaagtctcacaggtaatattccaaagcattgttatttctaccctgcaagctacatatcagttattaaaaatgctctacagccgagattaaaaaataaacatggcaattaagcagactgggacttggattttctgtatctctatggaacccaagatcaaatcacaccacagcggggctaactgtgaaaagaattgaatcttgagtttctctcgtgagaaagtatatttccttaaagtaataagtttccttattatataggaaatatagctgtcttttgtatttaaaaaaataaattaaattaaaatatacatagaattgcagcagttctaattatctttctacttgtctttctcttatgatacaatcacagaaatgttcccatcatccagcagttcatgcttatgagaagaatcaatgctttactcaatattaggaagattaatcaatggtaagagagtccactgcaatcacccacctgaagtggcatggatggctcttcagtatacggcatgggctacctcccaacagcccccctcagcccctgtgacccattcacgctggtcctaacaccagcttctacctgatcattgtggtgactccatgataatgctgaagccactttgggaccctcaggtcatcaaggtcaacactgggagtggtatcaccatactgctgttttgcagaagcatccaataatgagaaagttgggatatttagaaagaactataagctggcttttactgttttattttcagtgtgaaaaaagtgtaaattttatgtaaaaccagacttaaaactgtttcctgtttcttcattttaatactaaaagagtcaaggcttgtatgaatcaaaatcagtaattaaatagttcaaatttctttccatcaccttatcaaaatgccaatttcatagtctggagagactagcgacaaaatgatccattttatagatggttctttataagacaaaaggcaaacactttccacagcatcatcttctagggcaggtctgattttgtccagatttccaacctgtaaatcagcagtatttgcataaaaattcaacgattctactattaataaaacccaaagcccacttggaaccaggaaaaccagaatgctataagtaacaaatacaggcctagaaaggaaaactatttcatttctttttttatgctaaattgtatatacttaaggaacctgggggacattagctaagtgatatatgccagacacacacatacaaaatccatgatctcacttatatatggaatcttataaagactatttcatttataagagcatgtggcattctttttcccttgtccaataacatttgtgtcaatcacaaagcctggggtgatattgtctgcccgacacagactgacaaataaggacttcatatattgcaatttaaaaccccagagtttgagaacaggttaacatggagggacttgtgataatcacaggatcctaaatttgaactcttctctcagtaattgctttattactgagatgtatgcagatttcaccctcctactattctgccgtgaaacatctttaagaaaggcaaggcttattgcagaataaatatttgtagcagtgctgcaagttcaatgtcctcccttcacctccagtcttttgttcagacctactcaagctgtttccagataatatatatattgccttctcatccccagcttcccaagcctaacatagacttaaagactgagagcacttctagaatattctgcagagagtccaaagagatttcataatatttctgcaagggttggtatgcttttttttttgtttttttctcctacaaaatgctgtacagagctgggacgttaggggaagctagcatttagtatggaggtgatctcttgcattttcaattctttctttcactgtctttgcggctgcacttaaaaacagctttctataaataggactgcttgctcactcttaaatcttactcactgtcttctcagtaaaaaaaataactagggatacaggcaagattcattaatccctgtcattctaactctctgtgtagtagcctctttccttcttcatatcttgacatatatcttctcaatcccattcatccctctctgttaaaccataatatgtatttacataatccagggggcttcaagatcaaaaattaatccagttgcatgatttttaaaaaatcagcgttgatcacatagaacaaatagagatgtccaaaaatcaaaagctgataaatattgtaagctataagacacttaatttgatttttatatttggacaaaaatcaactttaacaatgattaagatatcctttcatgttactttgatgaagatagcaactgtcatatttgaatctgcaaaataagaaataaagataatgacaaaaaacccataaatccataggatgctgaagaaaacagtagtatgactttttaaagatgaattaaggcctgagaaagtaagctttgttttgatgtcctgggtggctctttgatgaagaaatgaattcccaagagctgggggtggcggagtgggcggggaacctaaatgtcggtttgatgtttctggctggctttcaaaatgcgacagggcaataaacactgtataggaattttaaatcatgccatttagcagcgtacacttgagaacaaggggtccagcacatggatgaaattattgtctgtgacacttgacccactgcacggcaggaagagcacctaaagcaattacatagctgttgtgcaacagtgatgaagtcccatcagatactcgaaatatgaatctctttttgaaaagagaagaaaatgccccaagccacaggcgtttctggaaaataaacatttctaccgtgattgagtcactacgacagaaaaaggtgggtagagcaaaagagtccagtggtttagtcagaatgcaagatagggaccaggagagcaagtccaggaaagcaaactaagagggggagccaatcagctagaggcagaagagagaggtggacgggagggaggaaggtggacaggagttaaggaggggagaaaggctctgcctatcactttttcctttcactccgtaaggaacatcatctatttccactactccataccatgtgctctgctctgtgctaaggacacgctcaggcttcgcacgcatttcagactatggaggctcctgtctagctagtgagagaggcagtcactagccaaatcagcatcacctaaatgcaggcgtaacgattaccacagactccatcaaggaaacagccaagatttttagaaaaaggataatatggagggaactgattttcaggagcagatttgtgaaacccaacccttctgaacgtcctggtcagaagctgtctgacctctgaaccaaaatcctgtccctgcttccctcctgccaccttgacagaccttgcgtcacctgcagaaaacatccgtgtgctccaccctttgaattcagaacgacatagtggatactccgtggggctgctggaatcttccattcccactgccttatcttaacccatagattcggcaagggaaatgcaactttgaattttctggcattttcacaacattgaagaaaagaacataaatatagttggggggaggggcgcggagagataagatgagcatttttgtgcccaggtctttggaacttgaagagttaaccccccagtccaggggaacaggtgttttccagtgggcctgggggagagggaagggggctcccggtcccggagccttgcctgcggagattgatggactgcggaggagcgggcacgtcagcatcacccctgtcaccatcagcaggagaagcggcggctcctggaatgacattggaaggtcagccaatcaggcgcggagctgctcccggagctgccacctccgaggcgcgcgccacgccggggttccctcgcggctttggaaagggggtgcaaatgcacccttctgcgggcccgctacccgctgcaacacctgtgtttcctttctgggcaccttctaggtttctagatattgctgtgaatacggtcctccgctgtacagttgaaaacaaaggctgctggacctcgcctgacctgcggttgcctttgcccggttcctgttagacgaactctacgacgccggagtttgggcgcagtgaacttgagagatcgtgggggaggcgtcttcagaagaaagcccctgaccatctgcatggagcagtcctccctcggtggcggctgggtttgctggctctgctgaaggctggctgcaagagtcttgtgaggtttgccgcccactagtgtcctatggcggggacacaatcggcctgcaggtagcaccacctccctatctcccaggctgagggtgcgggcaccaaggcccagcgtgcacttcagcgcagcagccaagaaaatgcccacacgcgcttgtttgtgtgggcacacccctgggtgcctgccctgctctggagaggtgggccacgcatggaaaccgaggaaatcgaagtgctcatttccgaaatactattgaatgcactgcctaatgcaaaatacattctttttcactacctattaattatttatgagccacattcataatcttacccgtagaattcagctaattttacgaaacctggatgccacattttgtaaatgcatccacttgataaacccatccttttattttgcaaacataaatttccaatctacagtgttcacaggtctttctttataaaatgacctctctctctccctctctcaatcaagttttaatacgcattgaattgagtctcttgtcgaaatactccgtgcaccttactccagacacatctaacataaaataccttgccagctacccggaggtccaggaattggggattagaattggcaaatattttagtcaaaattagttcccctaccagaatgctgtattgcgctggttctgccccccgtgactcactgatcccccgaggcagcaaaccgtggtcacaccaaaatgacaaaggagagagtcaaaaagtggagaacgatccactggcatttattgaaggtctgcgtggcattttgttttcctacagagggcatcttggaggggcatgcagcttaagttaaaaggcctcggaatttaggtgaaccctgagattatggatagctttttaatctgtttaataaagatgggggagaaagggaagtggaggcagccctgaaattgttcacctgataacatttcttccttacatacatttatgtgaattaaataaaaatcacctttgaagtccttaaggtgcatttgtatttacaaaggtctgcttctaattaaataaaatagcaagcgtgtgctctgtaatttcctatcaagtgaatggatgaagctcaaaggtgctgcatactcatcttctctttaatgagcaccttcttactcccagcaccccaccgtctctaatctccatgaccctcaggccccatgaaagcggatgcagtagaactgaaaatcccacagctcaggaaaagatgatgtcaggaatgcatgcatgtgtgtgtgtgtgtgtgtgtgtgtgtgtgtgtgtgtgtgtaaaaacagagatgccaggatactagcaaaactatattacatataataaatctaattcttcatcattctgtttgtctgaaggcctggctcttcttttagcaataattttaaactagaatgtgctctggggttaaaaccaggagaaatggtaatgaaacacaatgcagtaggaagctttgctgagaagacaccgagggacgtgtgtgggtgagtgtctgcacatacgtgtaccttggctccttgcactgtaacagaagctcgcgtgtatttccagaacattgcagaacaaattgactgctttaaaacacgatactgcacctcatcaggtgaggtcattcatttaagggtttaacctatgaagggcctggtcactgacttcttctttttttttttttttttttcaaaaatactgcctgcagcctgtctagcaaccatacttttattaagaaataactgtacttctgatacatcaataagaaaaatattgttgtctactgttaaaatgcagatgtattgtgggcttattttaatagccccaaatattaaactacataatcttttacaaatgaaaaaaaaaagttatcatgtcaggcattttgatgcttgaggcctagcaataatcagtttaggtattagaattcatcaatcttttatcacacacattcagaaatttttcaaagttgaggtataacaaaatatgacagttgttgacaaaaatattctcaattttttaaagtttaattcagataggtagaaaccatttactcttatatttttgaaatatggtcttacaaacaggcatagttccaaactggattcttattttatttcaacatgtctatatattttatgatcctttccccagtatgtaatgaacaccataccttagaaaactgtttaaagctgatttcccctccccccttcaaagatcctaaagctttacagcaggcttttaatgttttcatccttgatcatataaagagaggggcatttttatacaagacagttccatagccttctgctagattggatcagaatacgtaatacagcaatgtaaaatattcatttgtgtttgctgtttatgtctaatattgtggaatctacctatatttattacaataatggtgattatcagttgattttaaaagtcttgaaaataatacttgcagaactcactatatgagtacctacataatttttgcatatatttttcatattgcagaatatttgaggtttcatataattgtattaccatatataattatttctatgattgtttattttagttataaaatgctgattcagaaaaaaagtcacacacacatatagcatctctgtatcagaggctaatagtctgtatcagtatcataaattcttccataccattttgtcatacaaaatgctaaaactgtaaataaatactggctgactgacaaccagcacagcctctttcatcatcctgaaacacacacttcccaatggggtgcaaattttgtttcttcttataacccaggcctttccaaggagttcagaaaggtactccctgacaggcgaaacagggtgtcaaggctctgtgtctttggaacacatgtgtaggcatctctacatttcttaggaggtcgcattagcagaagagcagaaagggctgacttccccgacacatctccgcatgttccctaagcacatctgtccctgaagggaaattcccaggaggacacaggacaggtatggtgccctctgggaaagatgggtgtcttgtcagaacttgttgcaattctttcctgctaggaaatctcaaaatgaaagtttcaaacactttgctttaggttatactggagagcaaagtatcattttcatgttcattttgatagtaccttctttcaactctaccttttcttagtcaccgtttttttaaaaaattgacaatgctcatgcatttcttctggcctgttggtatgctgattctttaggcactgtctaggtaggcaaagaaaatgcactgccttgcagccaacacacagagcttccctgtgtgtcttccaggaaaatcttagagcctcccctttgcttctcgtattttctcacaagggccagatttcctctcttctcttcttttaccttctcttcttctcctctctctctctctctctctctctctctctgtctctgtgtctgtctcgctctctctccctcctctctttctctctctctctctcctctcttctggctaggggattctgcttaatggtttaatttcaactgtcagtaggttatacattttatgcagatgtgtgttccaaaatttgaaatgggaatttaagccgtagctactcccaggcgatgtcaaatgatgacaatttcctctggttcccacaagagaggaagccattcatacatgtaagttcatatttatgcggtgacaggcagcctaaggtgcagtcacacttactaattgggtctgactcagtcaagagcaatagctttctaaatacccaggaagaaatcatttcaaaatataatattggctgggcatgaggaaatgtatgctatttacaatattcactgatttcatttttacaactatacaggtgtttttttttttttaatttgtcaacatttcagatgatgtaatgcttatcagtgcatatttttacataaacgactgtgaggagcatgaagcagcacggggtgcatagaaggacagaacattcttaaagccctccttggtgctggagatacattgtactagcatgaaattacgtgtttgaaaaatctcaaaaagcattgaatctgaagggagatgttcctcattgacccctccacttgcgtgcacttggaatgtcacatccctttccaggttgtaatattcaaagtggcaatcttcctgtctctccttctgtcaccaaacctggtttattctgaatgaggcagctctctagtactggagttaggctctgagctgtcacttggctaggtaagcgccttccaatgattacagagcaatttctcccgggcctctccattgccacctcttctcccccaaaaaataaatatgatatttaaaaaataaataaaagcacgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtca

SEQ ID NO: 389 - DNA, 116398 bp, Homo sapiens
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggtaacagcatgggccagtttgtctgggggcccccgcttgggggcgcgacccctctctaatgcccaacgcttgccttgatgacacatattagcgattgtggaccgacaccttggatttttcaaatcccttcctaattacacaggcacccgcttggtcactggcccaacactggggggcttctctgccctggatgtctgcaccacagatggctgtggccccaggcttgcagagcagggacctggtcaagggatgtggggcgctttcttcaccttaaagttccccccaagccctctccggggctgtattgtgttgtaactttgttgaatttccttagcgggtctgaagctagcgagtttctaaactgtttttatccgtgatgcttctaagcaatgatctttgtgtatctgaggcttcatcttgtgcatttccacttgctagaaaagctgaaatcaggtttctgagctgcgtacaggacaccagagtccttattgaaggcgtttggagaggttttatccccttctgggagtgagatagggtttccagacaataccattttagttcttctgtcaaaccatcaggcattttccaacagtgccgccctaggtcaaatttagggtctggaggagaggaaaatgatcttcttcaagctgtcgttctagttaaagacagaactactaactaaaaaccaaaaatacatttgttcatctcccatttcccctcagctatagtgtagatatttgaaatatttatttctttttaaaaaatcttaatgataacatgaattatacaaagatgctggtttcctttttttaatccaaatattcaaagttgttttaaacatatgtctaaatttctaattccattcacatccaaataactttcaagtgggaactactaatgagaggaaggatggaaaaatcaatggtttgtaaactgtgaaggacatatttttgtttccatctggatttctaattaaaccataataaattgagtaaaattatcataataatgatgaatctaagttatggatgaatttgcaaaatggctataatgtgctcaaaaatagtgccattatcatcaacagaatggcaattgtatgcagagttcaattagagtctttcatctgttaaaaacttctatagatcgatcatttaataaaacagtgatgcaatatagtgcagtaacagtacctactgcactatatttaaaggcacatattaacattacagactggctattgtaataataaaaaaatgtgctttctttattgcttgaaaataacatgttactcatatatcattatcctattctttttctcaatatgtgtttttccaaaatccatacaccccaataagatctttctactagccatgatttcttcatgtctatagaaaacttcagagcatttgaggcttaagcttatttttgcttcatctatctgtttgtctgtttcatctggcagttttattcttggtgcattttgtgaacacattacaaagtatctaaaattatatattagaaattcattgttttatttgtatgattattttatcccatagttcctataaatcatactgctcaccaatactctcttttacagatgtcaaagactataggttgaataaatatgaattcactataaaccaatgaatgatttcttccagaaatatcagtttatttattgtagttgttcttcggctctgtgtgtgtgtgtgtgcatgtgtgtgagtgagtgtgattttttatgagaattccatgcaaatgcctctgtgataaatatttataaaccttttcactgtattgcattaaaatggatttccagctgtaacatggaacacaaaataaggacaacttcatgccttgaagcttcagatacttaaaaataataattttgtaaaatactgccctccttattatggaaaaaaggacattggttttagctaaagacttcaaaactgtcaagcacattcaaagaaaatggaataaatataatctcacattcctaaaacacatctggattagtctattctcatgctgctataaaggactgcctgagactgggtaatttataaaggaaaaagatttaattgactcaaagttctgcagggctgaggaggcctcaggagacttacaatcatggcagaaggggaagcaaacacgttctctttcacgtgatggcacgaaggagaaacgccaagccaaagggggaaaagccccctataaaaccatcagatctcatgagaactcactcactatcatgagaataacatggtggtagctgtcctcatgattcaattacctcccaccaagtccctcccaaggacacatggggattacaagaactacaattcaagatgagatttggatggggacacggccaaactatatcaatatttatatagtattttaataatcttaacaaattgttctcttaaacatatgaattttatgcttaccattaacctgatgttaacagctgattttcttttcctctctgtttccctttgattttaagttccagctttttggataagttggttcttaaatgaattttccaattgccttgaaactgaacattaagggtccagggagaccttcactccattaaactagaaggaaatggaaatatactgcccatacaaaaagatgcaatggtccctatagcagacagctgtttagaatgggtcttgtgtccttgctttgcggagttttcaaatacaagacttctaaaagtaaagaaattaggtttcttcccagtcagacttctaactggctctgtgcctcaggcaaatcatttaacttctctatgtctaagattcctcaaacgtaaaaggatgaattataatttgatttctaaaattattttacccctctagatttctctgtttctatggtagaaggcagaggatacagagtgagaaagctcagatgtccttgctttgccatttgagagcttctgcccttaggcaaggccctgaaattctgtgacatcaacacctcatctataaaatggcctaatagaagaaattaatagaatgatctattatgctggatacagtgtctagtacatagaagacgcacaagaatgtttttaaggcacccatctctgaaaaatctaaagggatttctgcctgtggcaggggaggaaatgacctaaaagcagaggagtctatcctgcatctgcaggtaggcatttcgcagtatagtttctatagtattcaccagagaccaggaaaagagagggccagagcctcaagcatagtatgaatgcctccttggtatctttccatagtttagccccccctaaaaaagtcaaagtgagtcaggacagcataaatattaaacttaatgccacacatgactgacaagacatgtcctgttctggtttccatgtcaaactaggcttgattctgttacagctaagcataccagctaggctgtataatgaccatcagaataattgcacaatccaaatcacaccacaccagtaattagaaaaaggaaagaaaaaacaaataaaataactcctgaaatgccaaaaaattggttctctttcagctgtatttccatttaaaatttaaagttttcaaatgttatgaaagtatatttcttactttttttcttcttgggctattgtaagagtctcatttaggtgtctgcatggagtctgggttccatgtggcagttgcagaataaagcacctgccattagaactgatgtgcctttttctagtccttcaaacaagtctcagttgatccatattttcagaactctggagggtttaccaaacagaatattacagttctggttgcattcccacaaaatttagaaagcatcaataaatctttcccaaagccaaacgagatcaaaatatctaaacttaagtgagctgcaaccatacgcattatctcatttaatcttcatgattttagaaattgagtatgcttacaatcccttttcggtggataaagaaactgaggctcagaaataatttgccaaagtaaacatgtttactaggttgaggaaccaggataatgaactcatgtagtctcccagtctacatgcttaaattctacactgcaggactcccaagtatgtagcaacaacagcttataatcaaagtaccaatttctgtatatactgatcctttccacatgaaagctatatacctaggaagagataaatattacagtcctcatgaagatttttctaagtggaagtaagaagcatcagagttatttgtgaaactttcaaatgtctcaccacagattagtgggctggagttgggttcgggtggtgtgtgtgtgtgtgtatatatataatgtatatatacatttaaatatatagtatatataatgtatatatacatttaaatatatagtatatataatgtatatatacatttaaatatatagtatatatatgagattctgagtcaaaattattttcatgatttcccataatgaaaaaaatttgtcccaatccacaatgccattttgcagccatagacagactaatcttaagaatcttaagtgttgtcttggacaggaggtatttagaaaaattataatgagaggataaacatttctttaatttagcctcaccagaatgtgagttaaatcaaatagatgtatatattagaatttaccagctgcaaacatgcaaggaaataaggacaaatttcgattaagtgcttgcacatgaccttatgattctcatatcttgggagagtttgcgacttataaaaactgctttatcttaccaagagtgacatctcaaacaccctgtctccttgctaaatgtaaacatttaaagaggtgatacttgcagcgttcaggatttctctcaaattccctacttttccttaaagtatggagtctcatttaaaatctttaaagtacctcatttaggccaggtgtggtaactcatgcctgtaattccagcactttgggaggcagaggcaggaggatcgcttgagctcagtttgagatcagcctaggcaacatagtgagatcctgtgcctacaaattaaaaaaaaaaacaaaaaactagctggtcatagtggtacatacctgtagttctagcaactcgggaagttaaggttaaggtgggaggattgcttgacccctggaggttgaggttgcagtgagccatgattatgccactgcactccagcttcggcaacagagcaagatcttgtttgaaaaaaaaaaaaaaaaaaggacctcatttaaagtctctaaattttccttctcattttactttctgtccttgcattcttggcacactgataataaactgaatgtggggtctttctaggatcacatcttccagtctttgtaaggatgctgtatctcatttataatagacaactctctcagcagagttcgtagtcttgtgtttccctttctacttactcatgatctcctcttctgtctggaattcctcatcctccacaggtgtgcaaactgttttgtttgtttttgtccttgggtagccgtttatatcatttatatcagtgttacttaaggcttcaaagcctttggctaaaatcttccctgtttgagggagtttcctttgttcctgctcttttttcagctggaaaaactacattaagtaatttctgtgatatatgcttctttcaaaactagtggccctatgcttcccttaacacagaagtatcaaagaccagcatgagcttgaccaatatcctgagcttgcttttgatattttgattatctaggttttagtaactttttctaattcatgtttacctacagaattagtgcccgcttgaagattctacagtatccaaagccttacagtttctcactgtctctatcctcagctctcatcttttttcctcctttgacaccctcgagtcttgaacatgccaagctcattctcaattacaacttttgcacgtgatgctctccctgcctgggaatcgtgagtctcagagctgcagggaaggggttctttaagtcatttcatctcgggtctggaatgcttctccacactactagtcctcacagtattgtctgatttgtgtcaaagcccacttgctagttgagactttctcatttatgtgttcacttattaatgattttattccccaaaatgaaatataagctccatgagagatgtacagtatgctttcatatttattgctggccttagtgcctagaacagagtctagtgcatagtagatactcagaaaatatttgttctgtgaaaattttacttccatttccctattagattatcctgcatctttttacaggtccagacaagttgccgaaacttcaaccttatcattcctgttttttaattcctttctgttgatcctaccttagctaaaataccaatcagtatattttttttcctgtaatatggaaaaaaatttgaaaaagctatcattgcaccattttaatatacattcaggttgcatagtatctgtatatgttgatttcaaagaataatctggatctgagtactaggaaaaacgaaaataaaaagtagcacaacgtttactttttattaaagttacattagccattccactgttttcactggcatgatttttcatgtttaaaatatattttgaaaatatatacatatatagagatataattttgcataagtgcctaaactaaattatatcataatgttgttttttaattcttgatttttaaatttcctttctttttttttttttttttttttgagatggagtctctgtcgcccaggctagagtgcagtggcgcaatctcggctcactgcaagctccgcctcccgggttcgcgccattctcctgcgtcagcctcccgagtagctgggactggcgcctgggttttttgtttttttttgttttttgagacggagtctcgctctgtcgcccaggctggaatgcagtggcgcgatctcggctcactgcaagctccacctcctgggttcacgctattctcctgcctcagcctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtaaccaatcttaattgggttctattatgttagatttttctctactcttatacccattcacatatatacactctcaaatcaatctttttgtcatcatttaaaaaatatatgcatcttgttttctaactcatgatgaccttgtggaaagccctccatgttgattgttatggataaaattcaattctaaatggctgtatataatataccgtgatatggataataagaaacaaattcaaccattcccttcttgataaacattcactttgtttccagaggtttctatcttgttgggttttgtcacaaaacaaggctacaataaaagtagttatttaaaaactactttatctccaggtttaaagagcaaagctatttttcaattttaatgtatgttgccttattgctttctaagtactacaaataattacatttttaccagaagactatgacactgttctttactcatgtccttacagcaataggtgttgtaactgtttatgttattagttgttaaattaatttgaatttcttaactacttgtgaaattaaatatatttttatcttcttcagatgtttggacttcttgtgtaaatcatttattaatattcttgctcattttactgagatattagtctttttctcaatttatacattctttgaatattgtaattattaatgcttatcatagtaggtgttttccatattgtcggctgcctttgttcataactttatcatgcacatttaaaatatttgtatagacaatatatttattattgtatacattttggattccagtgttgattaatatgattttttcttattgctgcattagacatgtagtcttctagattttactgaaggatttttatttttaaaaattttagcatgggtttttaattcaagtggagttttaaaacacatgccataaatagtgagccaactttcacttcttccaaacagcttactaaatattttattcttccccttcgaattgaaaacacacttttgtcatattttaaaatctcatatataatgggatctatatttgtatccttgattctgtttcactgaccaatttgtccatttctatggcaacaccaaattgctttgattatatttgccatagattatttttctgatatcctaaaaagcatatctccttactgtttttcttcacaaatgttcttagcttttcttgggcacattttcttccctctgaacttttaaaaatcatattccaaaacaaatcctgtcactgctttgcaaatatttttaccaaacgaactgtttgtctatacatattttaaatgatattatattaaattgatatgttaatttggggagatgacctataaagtattaaaatttatcttccaaaaatcaggcatgttgttcaattttaaagaaattttaaaatctttcagtagggttttattttttatgtcatcattttatattccatcttttgcctgttaaatttatttttatatatgctacattttagtcactgctgtaaaatatatatatatatattcattttaatttctaggtgctattgctaatattaagaatggctacttttaaaaaatttttaacttattttatattcagggggtacatgtgctggtttgttacaaaggtatattgtgtgatgctgaggtttgggtacagttgaacccattacccaggtagtgagcgaactacccaatacgtaatttttcaacccttaatcccttcctcccttccccttcttgtattccttagtgtctattgtgcccatctttatatctatgcgtttccaatgattagctccctcttataagtgagaacatatggtatttagttttctgtttctgcatttatttgcttaggataatggcctccagccgtatccatgttgctgcaaagtacatgatgctgttcttttttataactgcatagtattacatggtgtatatgtatcatattttttaaatccaaaccactgttgatgaacgcctgggttgatttcatgtctttattattgtgaatagtgctgcaatgaatatatgaatgcaagtgtcttcttggtagaatgatttattttcctttggatatataccaagtaatgggattgctggtttgaatggtagttctatttttagttctttaagagatctgcaaactgttttccacagtggctgaactaatttactctcccaccaacagtatataagcattcctttttctccacaacctcgtcagcatctgttctttttagactttttagtaatagccattctaattggtgtgagatgatatctcactgtggtttgatttgcatttctctgatgtttagtggtgttgagcatttttccatgtttgttgactgctcgtatgtcttctcttgacaagcatctactcatgtcctatgttcactttttaatggagtttattttttcttgatttaagctccttatagattgtggatattagacctttgttggatgcatagtttgcaaatattttctcccactctgtaggttgtctgtttacttcgttgagagtttcctttgctgtgcagaagctctttagtttaactagagtctcacttgtcaatttttgtttttgttgcaattgcttttgaggtttataaattctttgccatggccaataatatggcttggctgtgtcccccacccaaatctcattttgaattatagttctcataatccccatgtgtccctgctgttcttgtgatagtgagttctcatgagatctgatggctttataaggggcttttcccccttttgcttggcacttcttgctgccaccatgtgaagaaggaaatgtttgcttccctttctgccataattgtaagttttctgaggcctccccagccctgcagaactgtgagtcaattaaacctgtttcctttataaattacccagtcttggctatattcgtatagcggcgtgagaatggactagtagagtatattaatatccagaatggggtgctgctataaggatagccaaaaatgtggaagcaactttggaactaagtaattggcagaggttggaacagtttggagggctcagtagaagataagaaatgtgggaaagtttggaacttcctagagacttgttgaatggctttgaccaaaatgctgatagtgatatggacaataatgtccaggctgaggtaatctgagattgagatgaggaacttgttgggaactggagcaaaggtaactcttgtatgctttagcaaagagtctggaggcattttgcccctttcctagagatctgtggaacactcaacttgagagagatgatttagggcatctggcagaagaaatttctatgtggcaaagcattcaagagaaagcagagcataaaagtttaaaaaatgtgcaggctgattatgaagtggaaaagaaaaatccattttctgaaaagaaatttaagccagcagcagaaattttcataagtaacgaggagcagaatttaatcaccaaaacaatgagaaaaatgtctccagggcacatcagagaccttcatggcagccctcccatcacaggcccagaggcctaggagggaaaaatggtttcttaggccaagtccaggcccccttgctgtgttcagccttgggacttggtgccctgtgtcccagccactccaaccgtgggtaaaaggggtcaatgtacatttcgggccattgcaattcccaatccttggtagctgccatgtagtgttggtcctgcaggtgcacagaagacaagaattgaggattgggaacctccacctagatttcaaagaatgtatggaagtgcctggatgtccaggcagaggtatgctgcaggggctgatcgcttgtggagaacctgctagggtagtgcagaagggaaatgtggggttggagccctgagagagtcctcactggggcactgcctagtaggcctgtgagaagaggctactgtcttctagacctcaaaatggtaaatccactgacagcttgcaccatgcacctggaaaaggtgcagacactcaaagtcatcccatgaaggcagtcagtaagggggctgtgccctgcgaagccacaggggtggagcttgccaaggccatgggagcctacatcttgcatcagtgtgacctggatgtgagacatggaaccaaaagagatcattttggtaatttaatgtttaataattgccctattggattttgtgcttgcatggggcctgtagcccctttgttttcactaatttatcccatgtgaaatggtgtatctacccaatgcctgtaccccattgtatctaggaagtaaccaacttgcttttcattttataggctcataggtggaagggacttgccttgtctcagatgagactttggacttggacttttgagttaatgctggaatgagtcaagactttaggggactgttggaagggcatgattgtgttatgaattgtgaggacatgagatttgggagggtccaggaccagaatgacatggtttggctgtgtccccacccaaatctcatcttgaattgtagttcccaaaatccccacgtgtaatgaaggagatgtggtgggaagtaattgaatcacgggggcacttacttccatgctgttcacatgatagtgagtgagtcctcacaagatctgatggttttataaggggcttttccctgttttgcttggcatttcttcttgctgccaccatgtgaaaaaggacatgtttgcttccccttccaccatgattgtaagtttcctgaggcctccccactcatgcagaattgtgaatcaatcaaacctctttcctttataaattacccagtcttgagtatgtccttatagcagcatgagaatgaactaatacagccaatgtcaagaaatgtattccctgggttgtcttccaggatttttatagttttaggtcttacatttaagtctttaatccatcttgagttactttttgtatattgtgagcagtaagggtctaatttcattcttctgtatgtggtttgccagttatcccagcactactttaacaatatagattctttgaatctatgaacatggaacgtttttctacttgattatgtcatctgtgatttctttcaacagtgttcccttttatccacattctcaccagtgtcagttattttttgtctttttaatagtagccattcaaactagggtaagatgatatctcattgtggttttgatttgcattttcctgataatcagtgatgttgagaattttttttcatgtagccattggccatgtttatgtcttcttttaagaaatctctatttgtgttctttgtccactttttactgggattattatttttttttctgtggagttgtttcattccttgtatattctggatattagtgcctttttggatgaatagtttacaattattttctcccattcagcagagtctctatactgtgttcatttttttcctttgctgtgcagaagcttttcagcttctactaatcccatttgtctatttttgtttttgttgcctgtgttgaggtcttagccataaaatctctgcctagacaaatattctgaattgtttccctatttttttctagtaattttatagttttaaatcttagatttaagtctttatttcatgttgagttgatatttgtgtatgaaggatatgggtccagtttctttcttccacatatggatatccaattttcccagtaccatttattgaagagggtgttctttcctcaatgtatgttctagtccctttgtcaaaaatcagttcactataagtatctgatatactgattttgtttccttcggataaatacacagtagtgagattgcaggattgaatgatattctatttatagttgtttttgagaaatctccacattgttttccatcatggctgtactaatttacattcccacaccagggagtatttccacgttctctattctgttccattgatctatgtgtctatttttataccaataccatttcctcttttggttactatagccttataatatattttttaatcaaatagtgtgatacttttgcctttgctctgtttgctcaggatatctgagcaaccaagtacagatgctcctcagcttatgatgtataataaacccatggttaagttgaaaatattgcaattcccaaatgcatttagtacatctaaccttctgaacatcgtagcttagcctagcctaccagaaacatgctcagaaaacttacattagcctacagttgggcaaaaatcatctaatacaatacatattttgtaataaagtttgaatatctcatgtactttattgaatgctgtactgaaaagagaaaaaataatggttgtgtgggtactcaaagtatggtttctgttaaatgcatatggctttcacatgatcataaagtagaaaaatcctaagttgaccctttgaatgttggaaactgtgtgtattgatggtgcggagtaatgaagatttttacttgctttgatcaatttagaaagcaatctgatttcatacaattaaaaatgtatatgccctatatatgcataaggagatatatataaagatgtttattgcagtattatttataataaaataatgaaaaattaaaccattaattaaagaatgggtaagtaataggtaatataatcatgtggtaaataccacaggtaggcaaaaaaatagctgccatgacttggttaaatgaaaagactggatagatttgagtcctggccctgtcataactttggatagttacttatacttttcctgcttcagcactgtaaaatatagataatgctatggtttggaagctctctccaaaactcatgttgaaatttaattgccaatataatattattgcaaactggggactttaacagatgattaggtcatgggagtttcaccctcatgagtggattaatgccatcattgcagaagtgggctagttattacaggagtgggctcctgataaaaagataagcccagccgccttttgttctctctgtctcacatgcttgcttacccttccacagtgggatatccctcaccagacgctggcaccatcctcttggacttcccattatccagacccatgagccaaataaatttctgttctttataagttactcagtgtgtggtactctattataacagcagaaaaaaagacatactattcatactgaaaagtgaggctgtcattatagcaaagtgctgaaaaggtggaagcagctttggaactagataatgggtagaggctggaagaatttggaggagcaggctagaaaaagcctagattgctgtgaatgtagcattaaaggcaactctggtaaggggtccaaacaagaggagagctgtagggaaacatgaaactttttagagattacataaggggtggtgaccaaaaggctgattgaaatattaaaggtaaaggccattttgatgaggtttcagagggaaatgaagaacaatgttttagacactggggtaaagtccatccttgttttacagttgtaaagaccttgagtgaattgtacccaaagcctgagggctttgcagaatgcagagctttaaagtgatgaactaggatatctggtggaagacatacccaagcagcaaagcattcaggctgctgcatggctgcttttaaccatatacagtgagacgtgagggatgacttcaataaagattgtataataaaataagaaacagagtgaaaggatttggaaaattcacagcctggttatgtaaagaattaaaaaaaaaaaagaaaatttcagaagagagcactaaggatgtggccaagtgacaattgccaaagagattaatatggataaaagccaggtgctatatatcaagaccatggaagaaagaccctgaaggcatttcacttatcactgaggttgccccttccattataggcccagagctgtaggagggcagaatggtttctggtgatggtcttgaagcatcctccatgggctcactgcccagggttaacttgggtctccactcattgtgattctagcaatgtgcccctagtctgcactgggagcatctcatatctaacattttgatttaacccttttccaagtgggcatgcccagtcagggatctggtttagctctccctgatctactttgccccactgcccaggtttcccaaatcacagaactcataatccttgtgattacttgctcaatgctttgtcttttatataggattgttagcttaatgaaaactgttaagcccgaatattgtgtttaattcacagcagaagatcctaaatgagtaatgaatgaataaaaattatagaaatatatgcgtatatgttaataatagttgggtcttacagagtatttcaaatagtagccttctttccactcatctgaatttggagctatttagagatagacacacaagcatatatgcttccatttaggatagatgcaaacatatagacatcaaaatatcagctttatttctgttgaaactatttgagaatgtgtctagggactgtgggcaaggagtaaagttattcctaaatttgacagatttcccccactcaatctctcattacagggagatggctaacttcgtatatattacagttcatatcatattatgtgtgtatgtattacacacacgtatattacacacacacacatatatgtttatgtataggtcatctccctgccatatatatatacacacgtacgtaaatgcacagagagcatatgcactttattggcagcaagattcaatggggagcaacgaaaaggccagagacactcaagttcagtttcttcttcccaagttctggattcttggagaagtgagggaggagtcaggcaacttacccaagagaagatttcaggaatagagaataagttatctctagaagggggtaatttgggtttttggtttttggtttatattttctatgttttccaatgatcatgcactatttttaatcagataaaaattcctaaaacataaattgcaatcttaatttttcttggcctcttattttctcacaagtgttaatttggccaattcacaatatacatatatgcctgtgtaaaattgtagatctcctgtgtgggaatgaaagaagtatctgatggagaaaatgaacaaatagcttaaaaatatataaaagagaaacatctatattaactattcacaattacttggggatagcttcttgtgtgagaaaattatattttaaatgaagtggctggtgccaagtgatatgagtactaatttttttttaatgatactttggtaatgtggtcaaaatgtgaaataacttatctttttttttcaatatttttctactacttctcagtaagcatgagttttgttggaattattgtgaagttttagagttagaatgtaatctttttcgtaatttcacagatcatattaaaatttacaaatagttatattgcttatagagccacagtgaggggtcaggtttcttattctgccagttaatgtagtgtctgctttagaatactgtcatctaccctagttcacaatttttgaagatcttgtgaaagaagatatgtagggaagtcaataacaatgaatcttccaataaagaaaaggaagaaagttctcattcccttattttttgaacctaccttttaacagatggttttactgctctattacacagcataattggattgttttatctgaaagtgaataataaagacaaaactttaaaaatagaactgtttgaactgagagctcacttttattaagagaacttgtcctatgaaaattattatttggaaacagaaaccaaagtacatatattaaatagcatcttttgcaatcaatgtcaaggctgtgttgtgtctttggttgtcttttggtaaatctacaaaggagcatcaacttagtgtcctcataaaagacatatatgtgttccactacattcagtgtgaacaatattttaatttagcttgccaagatatagtgaaatagaatttttgcagggtgattgttctgttaaaaatatataaaagggcctagaaaatgatcttttggctaaagctgtagaaaacagactgccattgatttgcagaatatgctgtttgatgtttagacagctggaaaaagtttggtaggagaactttaaaaacctgttataattgtagccttgagtatgatatgatttggcaactaagagatcacctcacaaagctatgatccacaggcaatgcagtcttaggtattataaattcatatttatatcaaaaattccaaatatctattgagatattgtgatagaataagaatacacattttggtcttctttcccagctcctggccagacctcctgaaactcttgtaagtgctagtgataagagctataggagcaccttttattataatgtaattggtttttgttcctagctcttgaaatgcttctaaaaatgtgaaagaataaccttttgctagtcataacaagccccattcaactacacttgaatttatgtcaacgaagtgacttgtggaaagcccctaagggtgggggtcactggttgtgaaggaaatcaacaccatgattagagggttggaatttttagcactcccatccaaacctccaaggatgggagaggggcttgaggttgagttaatcattagtggccaatgatttaacaaatcatgcctatgtaatgaatatcctaatccttcatgaatgtcctaatcaaaggagtttggagattttccatgttagtgaacacatggagggctgtaagtctcaatctccaaactatacaaaccaagaacaaataatttcacacaaatcctttgccattgacattaaccagaagacagggtactatataaacccaaactaatattttaagcccccctaaccaactgaatggaaccctcttctttgccaagggcattcaaaagttaaactgaaaaactagttcagtctgtgatgggaaggggggttgtacgtgcttcattatacactcctccctttacaattcgggcacaactgaacagcattaacattaaaactgacaccttaagaatgacaaaacagactctttgcagcaataaaataccaaattccaacccgactctattataacatgacatggcaaatagcaggccctgaaggaaagcaacatgttttacctcaaaatacatttctttgatgtatttttttaaattatactttaagttttagggtacatgtgcacaatgtgcaggttagttacacatgtatacatgtgacatgctggtgcactgcacccactaacttgtcatctagcattaggtatatctcccaatgctatccctcccacctccccccaccccacaacagtccccagagtgtgatgttccccttcctgtgtccatgtgttctcattgttcaattcccacctatgagtgagaatatgcggtgtttggtttttgttcttgcgatagtttactgagaatgatgatttccaatttcatccatgtccctacaaaggacatgaactcatcattttttatggctgcatagtattccatggtgtatatgtgctacattttcttaatccagtctatcattgttgtacatttgggttggttccaagtctttgctattgtgaatagtgccgcaataaacatacgtgtgcatatgtctttatagcagcatgatttatagtcctctgggtatatacccagtaatgggatggctgggtcaaatggtatttctagttctagatccctgaggagttgccacactgacttccacaatggttgaactcgtttacagtcccaccaacagtgtaaatggaagtaaagctctcctcagcaaatgtaaaagaacagaaattataacaaactatctctcagaccacagtgcaatcaaactagaactcaggattaagaaactcactcaaaacagctcaactacatggaaactgaacgacctgctcctgaatgactactgggtacataacgaaatggaggcagaaataaagatgttctttgaaaccaatgagagcaaagacacaacataccagaatctctgggacacattcaaagcagtgtgtagagggaaatttatagcactaaatgcccacaagagaaagcagggaagatccaaaattgacaccctaacgtcacaattgaaagaactagagaagcaagagcaaacacattcaaaagctagcagaaggcaagaaataactaaaatcagagcagaactgaaggaaatagagacacaaaaaacccttcaaaaaattggtgaatccaggatctggttctttgaaaggatcaacaaaattgatagactgctagcaagactaataaagaaaaaaagagagaagaatcaaatagatgcaataaaaaatgataaaggggatatcaccaccgatcccacagaagtacaaactaccatcaaagaatactacaaacacctctatgcaaataaactagaaaatctagaagaaatggataaattcctcgacacatacactctcccaagactaaaccaggaagaagttgaatctctgaatagaccaataacaggatctgaaattgtggcgataatcaatagcttaccaaccaaaaaaagtccaggaccagatggattcacagccgaattctaccagaggtaaaaggaggaactggtaccattccttctgaaactattccaatcaatagaaaaagagagaatcctccctaactcattttatgaggccagcatcattctgataccaaagccgggcagagacacaaccaaaaaagagaattttagaccaatatccttgatgaacattgatgcagaaatcctcaataaaatactggtaaactgaatccagcagcacatcaaaaagcttgtccactatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggaagtatctcaaaataataagagctatctatgacaaacccacagccaatatcatactgaatgagcaaaaactggaagcattccctttgaaaactggcacaagacagggatgccttctcacaccactcctattctttgagatattttgaaaaggccctgcaaaactgtctcttgtgggaaaaatctacattctgtagagaatccctttccctttccaggtcttttccctgatttaggagagattaactaagagtctggcacctttttaagcctaataagaaacatttacaatctattctctttgaagcctgctacctggaggcttcatcttcatgataaaaatcttgctctttacaatcgcttatcttaagcagacactcctttctattaatttcaggtcttacataataacttaactctttcaaccaattgacaatcagaaaatctttgaatctacctatgacctagaacacccctaccccttgcttcaagttgtcctgcctttctggaccagccagtgtacatcttacatgtattgattgatatcgtgtgcctccctaaaatatataaaaccaagctgtagctcgaccaccttgggcacatgttctcaagacttcctggggctgtgtcgttggcaatggtcctcaggtttggctcagaataagtctcttcatatattttacagaatttgactcattttgtcaacaacttcaaaccaagttatctgtaaatagaaaacaataataatgacaacaacaataccaatttcaagcagagatgtttctcaagctcccagatctccaggctatgtggagaacaaagtgaatctgggggaaagaaaacagcatggaagagataatgagagaacagagagcctatgagtgaactaaaattgtccccagaaagagaaagtttaccctaggaacaaaaatactataaatagtactggaaattctataagaaagttatttttttaatatccaccagcaatgttttgtagttttaagcatatgcattttatacatcttttcttaaatttattaccatgtattttgtttttttatttatgataaatcaagtactttaaaaaaatttcttccaggttatccattgccaatatatagaaatacaattattatttgtaaattgactttatatcttgagaacttactaaattattatttatgatgactttcatatagattcaggattttctatgtacacaatcatgcattatgccaataaagacagttttagttccttctttctgatctgtatgtcttttatatttttttctaatgcactagctatatctccagtacagtgttaaaacagaaagaacagacatctttgcctattccttatctaagagcacagtattcaatcattttaccattgatgactatagtaactgtatgttttgtataggtctcctttctcaaattcccttttctcctagttttaaaaatcataaacagtattgaatagcatgttcatattttgagtctacatttatgagaaactcaatattattaagattttgattctcaaaattgatctatagattcagttgatctatagacactattgatctccattcaatctatagattcaatccaacaaaatctcagcatgctttttttgaagaaaataataagctattaatgtatatggaaaagcaaacaacctagaagaaacaacaattttttttaaatgaacaagtttaattagactacttggtttacagatttgctgtaaactacagtaattgagacagtgttgttggtgtaagcacggccatgtagacaaacagaacacaatcaccagtacagaaatagacccacacttatgtggccaatttattttagacaatggatccaagataattcaattagaaaaggttaatcttttcaataaatagtactggaactaccaaatattcctataaaaaattaaccttaactcttacattacaccatacacaaaaattaaattgaaatggaacataaatgtaaacatataagctaaaactataaaccttctataaaaatcataagagaaaatttttgcaaacttttacaggaaagatttcttaaatataacacaagaatcacaaaccatgaaagaaataaactgacacaattaactttatcaaaacttaaagaaacaatttttttgctctctgaaagacacagttgagaaaacaaagagacaaaccacagaatgggagaaaatgttttgaaaatatatattttacaaagtactttatccagaagatataaacaattcttataactcaatgagaatacaaagaaccttcacaaatggagatattaatagctaataaactcatgaaaaactgttcagagttctgtcttcatgaaaaagaaaactaaaaaacaatgagacatctctacaccatcatcctcaacaagggtgatatcatccccaaggtagcaaaaattagttcttaggtacagaggaaaattttctatattgtataatatacagattttatatgtacatataatacatatacacacagtataaaacagatactattaaactactaatatatgcaaaacatcaatgaatcttaaaaagcattagactaagtagaagaaaatcttaatatccacatacaggtatacctcatttgattgcactttgctttattgtgcttcacagtattgtgtttgcaaattgaaagtttgtggtaaccttgtattgaacaaggctatcagtgccatgttcccatgttccccaagcgcataggctcacttcgtgtctttgtcacatttcggtaattcttgtgataataaaaaagtttgaaatattgcatctgtgaacatgatctgtaatgctattattgtaattgttttggggtaccacaaactgtgactgcataaaatggcaaaggtaatagataagtgttgtgtgtattctgactgctctaccatagcacatagtagagcagatattctcccctctccctctccttgaggcttcctattatatgagacaaaacgatatcaaaattaggccaattaataaccctacaatggcctctaagtgtttaggttaaaggaaaagttgcacatctttcactttaaatcaaaagctagaaataattaagcttagtgaggaaggcatgtccaatgccaagacaggccaaaccctaggcctcttgagccaaacagctagccaagttgtgaatgcaaaggaaaagttatcagaggaaatttaaagtgctgctccagtgaatacatgaatgataagaaagcaaaatagctttatggctgatatggagaaagtctgagtcatctggatagaaaatctaacaagccacaacattcccttaagttggagtctaatccagagcaaggccctaactctattcaattctatgaaagctaaaagaggtgaggaagctgcaggagaaaagtgtgaagctagcagaggttggttcatgagattcaaggaaaaaaattctctccgtgccataaaagtcaaaggtgaagcaacaagtgctgacacagaaactgcctcaggttatccagaagttctcactaagatgattgatgaaagtggctacactaagtaatagattttcaatgtgcatgaaaacaccttctattggaagaagatgccattgaggactttcatagctagagagaagaagaaaatgcctggcttcagaacctcaaaggacagcctgataaggcagctggtgactttaagttgaagccaatgctcattgattattccaaaacccctaagttccttaagaattatgctaaatatactctgtccatgctctataaatgaaacatcaaagctttgatgacagcacttctgtttacagcatggtgtactctatactttcagcccactatggagacctactgctcagcaaagaagattcctttcaaaacattacttctcatttacaatgcacctggtcactcaagaactctgatagagatatacaaatagattaatgtagttttcatgcctgctaatacaacatacattctttagtccatagatcaatgagtaattttgactttccagtcttatttaagaaatacattttttaaggctataaatggcacaaatagtgcttcttctgatggacatgggcaaagtaagctaaaaaccttctggaaaggattcaccattttagatgccatgaatatttgtgatttatgggaggtagtcaaaatgttaacattaacagcagtttggaagaagttggttcagatcttcagggatgattttgagaagttgaagacttcagtggaggaagtaactgtggatctgatggaaataacaagagaactagaattagaagtggaacctgaagatgtgtctcaattgctgcaatgtcataatcaaacttaaacagatgaggagttgcttcttatggataagcaaagagagtggttttttgtctgttttttagagggaatctactacaggtgaagatgctgtggacattgttgaaatggcaacaaaggatttgtatataaatgacatgagtaaaaccacaataaagtgatatattgaagcctattgaataataaaagaatatattggttcatactgaaataaacaaatagaagaaagctcttccttatattggattgccaactaacaaatacaaaagaaataatagaatttaaaaattaccacttggcaatcatcatcatcatcatcattgactcaggtgggaaacatcaattaaggctaaaactggtgggtgcaggtttgctgaccatgtgagtttcctagggctgctataacgtatcatcataaatgtggtggcttaaaacaatagaaatttattttctcacagttccagaggccagaaatctgaaatcaaggggtaggaaggaccaagttgccttgaaagatctccgagaaaattcttccttgcttcttccagcttgtggtggctccaggaacaccttcgcttaaggcagcataactccaacctttgcctttgtcttcacataaccttctttgttgctatgtctgaattttcctctgcctttctcttacaaggatatctttcactggatttagggctcaccctaaatttcgggtgatatcattttcagatccctaattatgtttgcaaagaccctttttccaagtaaggtcacatacatagattccaggtggacaaatctttggaggagtcacaaaccaatgcacaacagtgaaaataggatatttacagagtatctcccacaatatacttattaagtgccaagggaaaagtagatactccataatggagagacctggcaaatcaaggtcaatgtcatcaatagtagtacaaatgtatattgcatccctccatgcgtgatgcactatgaagagtaccgtgtcacttctaccacatttctgccaaaaatgcataatgtgaatctaattctgagaaaacctgcacaaatccaaatggagtggcattctgatacttccagaaacctcaaagttatgaaagacaggaagagaggatggagaggcttggctagttaaaaattgtactagaaaaacatttcttcagctctaaaagacattgccaggaggtaataatatttgagtaaggtctttgggtagagacagcgttttatcagtgataatttcctgattttgattatcgtgttgtgtaggagaatgtgtttattttatggggagtacacactaaagtatttatgggcacagggacattatttcaataacttactcctagagagtttagaaaatactatgtatatacagaaagaaaatttagtaaatatggcaaagtgtgaatatttggggattctgaaaagtatgtggcagttctttgtataactgctgtaacttttctctagttctgaaattatttcaaaataaaaagtaaaaaaaaaaagacttttgaagaaaatatctacttaccccagaggagtctggttcccaaaattcattgtggctggaacactgatgtgatatatgttttaatgcatataagctggtccctggcaactaagccagtgacctgactggttttctgaagcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaacagatttattccagttgcgtaaaacagtatattaaattctgaacctttgggggaaaacaacatatgtaagtatagacgttgagctgagaatttagaaccccgagcttgtcattcttattattatttggggatttttccgatgaggtcagaagccaacccacctgagtccccttcatcatcacttttctactaaagtccccatttagtagctgctgagttgttcattctaaaccttgcctttaatggacatttcattctattaaaaaacctgtgataatttaagtaacttttttgccactgcatgttagagattacaaatatcacatttttcactgcaagccatttatgtaccttatacaatatcagtcaacagtctcttaaaggagagtttcgacagcagaaagacatttaagtcagagaatatatgctcacaaaagcattagaaatattggaggatcaaagatcagggaaagctgctgctggctgtaggttttagaaatctctatcaagttttagaaaaaaatcaggaaggtgtggaaccagtgtcttcactgcagcactgacagtcatgatttgcaaagcacctggaggctagtgaaacactttctatctgctgaagctcatagagctgactgtcactgctggaggagcaaagtagagctttctgcctgtctttcaccttccaaatctcataactgctttttgctgttgcacctaacccagaactaaagaagttacttgtttccagccctgcgatacaggaatattagagaaaagctgagactgtgctaatctatcactagacaaactgacatagtggttaagagaatgggctttgaagctccggagccagatcacctgggttcagagccaggttcctccacctactatttctatgaccttggcagggtgcccaatttctttgtgcctcagttgtgacagttttgaactgtagctaatctccctacctcaaagatttttaagagttagttcaatatactatatgataatgcctgacatatgtatttctttgcaggaacatgggtaaagctggaaaccatcattatcagcaaactaacacaggaacagaaaaccaaacacctcatgttctcactcataagtaggagttgaacaatgagaacacatggacagaaggaaggaaacatcacacactggggcctgttgcggggtgggaggcaaggggagggagagcattaggacaaataacataatgcatgcagagcttaacacctagataatgggttgataggtgcagcgaccaccatgacacatgtatacctatgtaacaaacctacatgttctgcacatgtatcccagaacttaaagtaaaataataaatacataaggacagaaagaaagaaattattactaaaatatatgaatgtagaaaatggttttgcaaaaatgcaaataaagtgattaggcattgcataatctgtttggaactctttggtactcaatttttttttttatttgaggtatttctttccacgggaaccataactatttaactattttaggtttacgttatgtttgaggctaaatatactagcagctagcttatgtttaatcagcattgcttttacataaaggacactcatctgaaagctcaaggtagtatacttaagtcattatattttactttttcatgaaggccaaggaaaaatgccacaggtctttttactcttcttggtaggatcataattttgttaaatgtccataaataattaagatgcctctaaaggtttgctccataactataaagtaataaaacaaaatcttccaatttgaatttctctggaagcattgattgcaacttaatcaattaaacttttcacaaattgactttataatttcataatgttttaaattcattcaagactaggtatactgtaatagattgtaaaaaaaaaaaaaaagaagtcgtgagtcttcattctttcccgtatctatgtcctttccaatgtgaaattgtagcttcttgcataaagacgtgaaatcttcccgatccctttaatatgggctgcacatgtgacttttttttcccaacaaaatgtaatggtactccaggttgaggctttgtgattctttcttgctcctctgcctttatcatgagaagatgctcaagctggcctgttagaggatgagacttgtggaaccatatggagcagagctgattcagcccagttgtctcagttaaagccccagatgtgtgagagaggccagttgaaattagcaaagccagcctatagctgaccaatgatacacagatgagccaaaccaagcccacttcatattagttgaatttctaggagacttttgagaaaacaaaacaaaacaaaaaacactgtacgtcttgaaggttgtgtagttggttgtaattattgcagcaacaggtaactgtacatacacagtgacatgattacaaactgagcagtaagtatatttaaattcaaaaagtatttttgtttagcaatgttataatagtagcagtttcatctttttgatgctttttctaaatatacaatataatgctttcaaaaacattaatttagggaaaatttagagcatctgcattcataaccaaaagtatgtttatatttgttattctaccaagggtctataaaacaagtctaaagaatttattcattggcaaaatgaattttgcatggcaaaattttatggcaaaacatacaaatcagaagcaattattcattccttgcattttgcattctacactaacttgctgcctacgtcgaagcaaacaaggtaatttgaataaataaatggtttctctttaataatgttgtgcagcagggaagtcagcttctaaagaaatggttttgaagtgattaagaagaaaaagctttataagtattttaaggctattgagttactctgaggataagtaggataaatgttatgagtagaaagcagagcaaggtttcaagcattcagcaggcaaggtttcaaaacataatattagttggcataaataaaaataaaagttcttttcagtattgcttgagaaaggcaaaagtggttatttccagtcagcccactttaattcagtacctggtgaagttttccagctggggcatatggcgcatagaaatgacttatcaaaagaggggcttcaagatagttcaagaaaagttaatcttttacctataatgtgttagccattctgctaggtactgagaacagagctggccaaagacaatgattttaaatctgtgtgaaatgcagaataatagtatatgcaagacatgagaaacaaaatttgtctatgtggctagagaatgattcacagaggagaaaaccaatgactgggtctcgatttacgtttatagtttaccatttaggaaaaaaggatgacagtaataaaaaggaacagtataaacaaaggcatagggatgtgaatgagtgagtcacaatggaaaattccacccaccaggaacatggataacccaggacagaagaggatggaggtaaaatatgatagtactgatggtatattagttatttatttctgcaaatgaattagtgcaaaacttactggcttaaaaacaacaatattaatctcacagtttctgtgggtcaggagctcagcatggctcacctgggccctctggctcaggatctctcaggctgccatcaaggctgctgtcagcctcatctggagggacagtgcagggaggatccacttccatgctcactggtcatcagcaggatccagtttttgttggctattggcctgaggccaccctcagttccctgccaccctccgtaggcagttctcaacttctcagcttgtaagcaagcatggagagccagagagagtgtgagcaagatggatgtcaatcttttgttacctaatctcagacgtgacttctgtcacttttgccatattatatccattaaaagcaagttactagatccaacccactcttaaggaagtgggaaggaatataaagcaaggacatagatagtaggagggagggatcattgggagccttttagaagcagtccccaaaagatggtaaaagtaattccatccatcatgagtgacagtactaggaaaagaggtcggtgataaggatacatgaaattgatgagacagacagttggtaaatgatagggaacattttagtgttctactgaaatgactagagagcctgcataggtaggatacattgatccctgtgagtagggctaaacaatgctaacaatgatcacctgagacatctaggaaaagaagagcttcgaatgcccacgtggtggagacttgtttcttacttcttctacacaggcaagatgctgctggagggatgcttgcagcctaacctgactgccaaatatgaaaagagaaaagaggaggtgaaggacagagcacaatatcaatgcatccaagttgtccagtggccagagacagaaatctgaaataaaacaaccagcactggttgctcagagaaaaaaaaaaaaacaaagcttatgacaaaggcaattttcacaaaaataatatcaagaatattttaaaagataatttagaggattaaaaaacttcattaaaaattatttttgaatgaaataattccataggcaagtggaaagaaatgacattaacattgagaactgaatcagaaactgaaatatcaagttaaagaatcaggtctctgaaaaaaatcagagaccaaaaggaatgcgatggaaataatgaatgcaaatatgtaaataatcttaattcttaaagaagaaaaacatatcaagaaatgacaggcaatcactaaatatatgagagaaataagctcttggtctcaaaaagactttcttctccaaaagattgaaaggaaaatgaaattccattattaatgttttaaaagaaactcctgatcatatgttagtataattactgaattctgagaataaaacaatttatcctattgtaaattatacaaattgacccaaggagatacacattttcttctaagacactctctttcagccaaagtggtttatttgctattcattaaatgcagggcaccatcattcctagtcccattttcttctagtaggagcagcctttccccaactacacagttggaattggagagccaaagagagtgctgtaataattacattaagactagcagcagggtacaggaactatcccaggcaaatctggtcctgtggttctccctacccagatcttcagaaggctcatccttgcgatgcccttaggactttgcttaagtgtcagcttatccacttccctgaccatcccctagtgaattaatgaactactactcatgcaagcccccttaccctacttgatattttgcctcatatattatgcatttatttgttatatctctccacctgtcttagttaatttgtgctactacaacaaaataccagagacaattgtaaagaacagaaatttgttttcccatagttccggagctttggaagtccaagatcaaggaactgtcaggtttgattgtctggagagggctgctgtctgcctccaagatggcaccttgttgctgcatcctctggagaggaggagtgctgtgtccttacaaggtggaaggcataagggcaagagggccaaacacctagtgaaggctctttcataagggttttaattccactaatgaagaaggatccctcatgacctaatcacctcttaagagccccacctcttaataccatctcgttggtcattaagttttaacacctgaatttttgaagcaatacatccaaatttatgtccctcttagatgaaaaatatattcagtccattcccatagcccctaaagtattaactatttctagtatcaacttaaaagtctaaagtccaaagtctcatttaaatatttctcaatcagatatgggttagatgcaaaggtgtatatcatctgtaggcaagtgtccctttagctgtgaatctgtggaattaaaaaagttatgtgcttccaaaataggtggtgggatgggcacaagttagatgtttctgttccaaaagggagaaacaggaaagaagaatgaggtaactggtgttaagtaagtctaaaatccaacagggcaaacaacactctatcttaagccttgagaataatctttgactccatgtctcacattccaggaacaatggggcaagggttaggtccccaaggctccaggggactacaaccccatggctttactgagtgtaccccaagcagctgccctcacagattgaaattgggtgcctacagctctcccagactggcattccgcattggtgacagatctaggctctctgaggtggctctgctcccatggctccattaagaattgctctactgggggctctctgcagtggccccaacccctcggctctgctgggcttttcccaggttggggccttattcaacacatgagcaacagtcctctccctgggccccgatcctctctgaggggcgtcctttgaaatcttggtggaggtgaaatcatgccaccacaggtcaaggactctgtgagcctgttgaattagcatcgtgtggatggattctcctgtttatagcattgtggcttacagatcatgccttgcagagcagtggcccgagttctacctggcccactttagccaccgctgaagtggccagtgagcactgtaccagaatatggaaagaaaggacttacagtaacgttgggtggaaagccctgaggccccacagccaccctgggctcctctcttccagcttttctgttctcaaggcctagcactctgggtgtttgatgggtactgcagcttctaaaatgccttcagtgtcgtgctcccattatcttaatgaataatacctggcttccttctattcataataatcttatcaaatggtctcttgggtataccgttggttttctctcctaaacaagcttttaaaattctgtacatggccaggctgagcattttttcaaatctttatattttacttttgttttaactataaattccttcttcagttttttttctctcttctcacattttactataaacaggagaatccatgtagcaccctgaatactttgcttatagagatttcttccaccaaatttcctagttcattgcttttaagttctgcctcctacaaagtcctaggacatagacactgttcagacaaattatttttcactttataatgaggacagccttttctacagtttccaataccttgtttcttatttccatctgagacttcattagaatagtcttcgctaaccatgtttctaccagcattctgttcacaaccactttaagtaatctttgggaagaatgaacctttccctgtagctctgctcttcttctgagccctcatcagaatcacccttaacactccattcatggcaatacaggcttttttcaacatttacttcaaaagttttccagtctgtagccattacccaattccaaatctacttccctatattttggtatctgttatagcaacacccacttctttggtactgatttctctcttagtccatttttatgactataacaaaatatcacagactgagtaatttttaaagaacataaatttatttcctcacacttctgaaggctgagaactccaagatcaagatgtgggcaggttagttgtctggtgagggctgttctctggttccaagatggcaccttgttgctgcatcctctggaaaggagtgctgtgtcctaagatggcagaaggcatatgggcaagagggccaaacactgagtaaagctatttttataaaaggcttagtcccatttattagaaaagagccctcatgctctaatcacttcttaaaggccctacaatagtacttaataatatcatgttgcccattaagtttcaacacctgaattttggaggagacatgctcaagccatagcaccacttctatgagagcagggccctctctgtttagtttactgctgtatctatccttgtgcctagaacagacagtggcatgtcataggcattcagtaaatacggttgaatgaaccaatttttgaattaatgaatgaataaatgaacaaagcagaaaaattatatagatcaatttccatagaaaaaaattggaaggggattagcagatggattcaggtgagaccgcatagaataacggttctatgctagagaatagaacttaataatgcttaagttctagaatatgaatgcctgaggttcttagtttttttttttttttatcttatcttttttcctgcatggctctagacacatatggtttgatttctttatttccaggtctcctcagttgcgaaattaggatgttaattatagcttttgacatacaagaaacatcaaaaagattgaatgtcttaataagagtgaagcatgtagatcagtgactgctatgtaagtattctaatattattttgatcttttgaaaaagagataataccaacactacttaagctattctgatgaggaaaagataagaatagcataacagtaatgctaagccttataaagactgactaaatctcacttttaactagagaaatatcatttatgactacagatttttaaaaggcaaactattagcaatctggaaattagctgtgtgtcaaaagaacactggattatgacctatgaaaaaatatgaatgcaaaggtagtcaatagtaaattatcaaattatatcattatgtaaacacaacatagcattttaaaaactataattgtacaatcacgttctaaaaaggcatttcaaataattcagcagtctttcctgattaaagtgctaaataaaatataaatttaaaaaacttttaagtataaaacagggtcttcaccaaagtccaaccggaaaaattctaaaaagtgaacttttaaagccatttttattaaaataggaatcagacaggtatgcctatgatcactgcagatgttgttattactattagtcaacatgaaagttttaaaacgtttgcgataagacaagacaataaacaacactgacaaaagatataataaagtcaaaagcttttccatagattagaaaaatatttaatgtacagaatatttctgcaaattaataaatgacaattagtaacagaattattggaaatatgaataggaaattcacagtaaagtaaatttaaatggcaaataaacatgaaaatatgttcaacctagtaataaggaaatgtaaattgttttaaaagttacagaataccttttctatatcagattggtaaatataaaaaaattgatcatacaaactgttaataatagccgacatttataatcaagtactgatttatgctagggactttttcatgttctatgtatatcaagtcatatattctttgtaacaagcatatgactaaaactaatattagtctaatatatcaatactggtattattattcctattttacacccaattaaaccaaggaatatagcaatttagtaatttactcaaggtctcacaggtgaaaagttgaagagctataattgatccctagcagattgaccctagagattgctcctttaaccactacactaaattttctcattgctatcagcaacataagtaaagtgtccttctcatatatagctcattgaaataagaattattatagtttttatagagtaacccacactatttattgaaattagaactatggcctttggcccctcacttcacttctaggtttgacaatatttatttgtgaataagcattccaataggaataaccataagcaaattcagggaggtagaggaacacacagtttttaaaggaaaaatgaggagggtcacatacatttttttaagaaaattatccttggctacaagtatcaataatacgggtggcatcagtccaaagttggacaggcagttgctgggcagatatcctcatggaagtatcgtgtgtgtgtgtgtgtgtggggggggggggtggggctctggtggcctttgtgcaagattgtgtttttatgcagagtgttttgtgatagttattttatcagacacaaatgcctgaggaccctcccctcatggccttccgcagctccatttgtcagggaagtggctccattttgattctgacaactttcacacactttataggaaaaaaaagtacatgaatgtaaagatgtgtacaagattgtttattgcagcatgtagtactaaggggtggatgcatagcaataggtttaatgattgaaaacgtattgtatacttgtaatgaactttgtggttgtttttataatatccattcccattttcttaggatcaaatttatttcgacaatgtttcagccttcaccctcttgccaatagttcatgttctttgagagggagagtaacagttgactgcatttctagttttaaaagtggtacatgtgactgaggctttatcactgttagcaaattatcaaaagcaaataatgttgaacattgactgagaaaaaaacataattctggacatcatcttcagaaagtatgattcaatagctctagagttactcctccaagaatctatgttttccttttttgttaaccaagctctccaggtgtttctcatgcacagacatgtttaaaaacaagcatgaatatcgtaaatgtcaatgctgtatggtaaatatcacctagctgagactatgaattcatggaggaaagtgtaattaattactaaggtcagaggtacaggcaagatttgacactttattgatttttgagtattaagtgagattttgtttttgtgaggagcgtgtatgaccccccaaatagaagatagtacagagtggattcttggaagatggtgcagcataaagcatgtgaaatctttctccctaactagacaataattgcactggcacaatctgtctgatgtaactattttggagctctacagtgtattgaaggcttgcagttgaagacttggatgataacttgcagttaatttcagtaaatttcaactcttggcacaaaaccatccatcccctacctctcagccacatgacaggtagatctgcacatgtacctggaatagcttgaacatagcttgaagaagcctgggtgcacaaaaaggaccctttcctttatatactggggatctatgccctgattgttacttctgattgcagatgcacaaagaggctaaagccattgttgttttacctcctcccattgctgcaagcccttccccttctgactgaagtgactgccagggccaatgacttccccttcaccttcatttttctctttttccactttgtgagccagacattgaagactagctcattgaaaagaaaccacatacacgagaaaattagaaagtcaccactcatgcccaggggaaggcactggctcagaaaaggccagagaatacattaagtttgcccctgtggtttattcttggcacagagatagatagcctacaacaatcaagaaacaacaacaaaaaaagcagcaaatcctggtgaagaggaaggattcagtttccagcattgctgtaccattagattaacatgtctagttttcaccagaaatcataaagcatatttacaaaccaggaaaatatggctaattcaaaggaaaaccgcacaaacttcccctgacaaagaactgatagtggagctatgagacacagactttgaacaactgtctcaaagatgctgacagaaccaaagcaagacatgaagaatgccaagaagtcaatgtatgaaaaaaatagaaacataaatgaagagacagaaaacctaaaaagaaagaaaaaaagagaatttggagctgacaaaaaaaataactgaaatgaatagtcactagagggattcaagagcaaatttgatcaagcagaaaaatcagctaacttgaagataggaccatagaaattattgtctgagaaacagaaagaaaaaagattgaaataaagtggacagagactatgagtcctgtgggacaccatcaaacagatcaacatatacattatgaaaatctcaggggggaagagaaggaggaagaggaagagagaatatttgaagaaatcatggctgaaaacttttcaaatataatgaaagatatggaaataaacatccgagaagttcaatagattctgagtagaataaactcaaagatactcaaagtgagatacattatgatcaaagtatcataatcccaaaacagataatgttgaaagtagctttagaggagtgacttaccacataaaaaggatctcaatactattatcagcaaatttctcatcagaaaccttggagcatttcccctatggataagaggaactaaggtgtagaaaaaaatagcaaaatggcagcagtaggtccctatttatcagtaattgcttttaatgtaaatgaattaaattctccaaccaaaaggtagagatcagcaaaatagagtttttaaaatgattcaactatatgccatctacaagagactcattttagatccagaaggcagtggactgatatattcaaacttctaaaagagcaaacaaagaaacaacatgtcaaccaagaactgtgtaactgatttaattgtatattttgaaataactaaaaaagtataattagatggtttgtaacaccaagaataagtgctttagggaatggataccccatttttcatgatgtaattattacatattgcatgcctgtatcaaaatatctcctgtaccccataaacatatacaactacaatgtaccaacaaaaattaaaaatgttctatagctggcaaaactatctttcaaaagcttaccactagaactgccctgcaagaaatgcttaagggagccctgcaggttgaaattaaagaacactaaataataagacataaagatctcaataaaggtgaatacatatgcaattataaaagctaatggtgtggtaactttgatgtatgattctactttttgttctctactctatttaagagacttacacatttaaaaaaattattagtgtcaaagttagtattataactttagtttgtaaattaacatttttttctacataatggtagagatgaatatattaaaatttattagtttatgtttcttaaaacacaatgtgtaaagatataattttataacatcgacaactaaaaaaggtagtgctgaagctgttaaaggtgcagaatttttatgttattaaaatgaaatggtataaattcaaattggtgtaacaactttaggatgttacatgtaatccccatggtaactacagaaaaataactaaagagtatactctaaaggaaatgagaaaggaatagaaatatttcactacaaaaaaattagctaaacagaaaaaaagatggtaatgcagaatatgaggaagaaaaaagctataaggcatagagtggtttcactttccatgggtttcactttccagggtttcactttccatggtttcagtttcccatagtgaactgcagttcaaaaatattaatcaatactcttgtgcttttgaaccagaattaagtaaaataagggttacttgaacctaagtactgcaatactgtgacaaataagctgctaaccaagatggttattaggtgactaatgacaatccaggtaaagatttcatcctgctcttcagaatgacatgcaatttaaaacttatgaattgtttatttttggacttttcaattatgtcacgatgcctacataattcacctcataaatctcatcacatagggattttgtcatctcacttcatcacaagaagaagaagggtgaggacagtgcaataaatattttgaggaagaaacaccacattcacataatttttattacagtagatagctataattgctccattttattactactgtatttttgttaatctctttctgtgcctaatttataaattaaactttatcttaggtggttatgtgtaggaaaaaccataatgtatatagggtttagtactatccatgattttaggcatccactttgggtctgggagcgtatcccctatgggtaaagggggactactatatagaaaaaaaatcaaaatgacagaaataagaccctactacttatcagtaattacttttaatgtaaatgaattaaaccttcccatcaaaagacagagattggcaaaatagatggaaaaaaacatgatccaactatatgctgtctacaacagactcactttagagaccaagatacaaataagttgaaaggttgaaaatggatattctatgcaaacggtaataaaaattcagaagaatggctaaactaatgtcagacaacatagactttaactttaaaagattatgagatgaacaaggacattacatattaataaaagattcaatatggcaaagagacaatataaatatgtttattttttgtgatggttaatactgagtgtcaatttgattggattgacgaatacgaagtattgatcctgggtgtgtctgtgagggtgttgccaacgaagattaccatttgagtcagtgggctgaggaaggcagacccacacttaatctagtgggtgcaatctaattagctgccagtgaatataaagcaggtagaaaaacatgaaaaggtgagactggcctggcctacatctttctaccatgctggatgcttcctgccattgaacaacggactccaagttcttcagttttggaagtcaaactggctctccttgctgttcagcctggagacagcccattgtgggaccttgtgattgtgtgagttaatacttaataaactccattccattagttctgtccctctagagaaacttgactaatacatttaataacagactaccaaaatacatgaggtaagaaatgactaaagaactaaagggagaaatacacagttttacaataatattcagagacttctatgccctactctcaataatggagagaaccaccagacagaattataactaaggaaacagtggacttgaacccataataaaccaactatatctaacatacatatgtggaacattctacccaataacaataggatacacattcttctcaggtacatgtaggacataagccaatcacaaaataacaaatactgtatgattccacttatatgaggtacattgagtagtcaaaatcatggggactgaaagcataatggaaattgccacaggctgggaggagaaaggaatggggagtaattgtttaatgaatatagaatttcagctttgcaaaacaaaaatagttttagagatgaatggtggtgatggttgcacaacaatatgaatgtacttaatatccccaaactttacacctaaaatagttgttactcaaaataataaaaagtaaatcaatctctctctctctctgtcacacacacacacacacatacacacacacacacacacacacacacacacagagagagagagagggcagacagcacaagccaaagcaggaaggaacaaagcactttctatacttgggaaataacaaaggaccggtaaggctagacggcatagatagtggagataagtctagaaagttgggtaaatgtcaaatctagaaaaataattgatgctatgttatggagtttttttttccattataatttaaagcaaatacatttttggattaaaaaaataaaatgaccttatttgctctatgtcttgggaaaaaataatatggaaatatagatgggagaggaaagagaattgagtaagatactttgtatttttggtattttgagaaaaactatttcatctatattatatataaattgttatattctaacaaaagttgatttttatgtactcatttatatctccttttaataatattgagtacaaaccatttccctaataagcatgtacccccaaccagaatattaagagaatacagggctttggagtgcccaagaaagacatcatgatttgatatgaaaataagccattgttttgaccatcagcaaatgatcttagcaagtacagattcagtggaaaatagaggcagaagccaaactgctgtgtgtggaagaataaatggtggttgaaggggtaaagacagcatcatttttcttcaggatgattaagagtgactgctagagcaggaggccagcttgagggtaaccagatcattttagcacaaatacaacctaatgtagccaagtcctgagagagcaagcaaattcattcaacagtcatccagcaagaatgtccctcatcactcctttggtgctgcactttcacacagtatatctgtaatgtgatcatgaaaagtaattaaagaaacagtctgcactgtcagtaaagcattacatctaagtgcttattcaatgttactgcctttagtcatcagtattttcaagaaagagtaaaatattgttcttttttctaaaaagtagtaaatcatctaaattaattttatcttattcttattttcctccaaatgagaacatgtgctactccccttatcagttaatgatttgctgaggtacataggataaaatagtctttaaaaaatcttttgtttatgttcattggtttccattttctacctctatcttcatcctcatattcagcctattttaaaatacttctttcctgagttccattcttccaggctttcactaatgtaaccctgtacattacactggatatattggggatttttgttggctggcataaacttaccacaagaaaattttgtttctacataatattttatgaaagtactaaaagctaccactatcatctcttctagggcctgtcatgggccaggaaaatgacaaattagctgccaaatctaatgaaaggttgattaaatataaagggaagaaaaattcaaccatcctcatacactgacaactgaggtttcttgcttttttctttccaaatgcccttccaatgaggggaagacaaaattaatatctcatccacgatttcagtctggcagaaaatgaacctcttttacaaacaggttgattattaattagcattcctaaaaggttgttcattttgctaatcttaaacactgaaattgaaattgctgcagatcttgacaggcacccactgaaagtcctcactccttaaataagagcttcatcagaaactatcaaatcttttagcacagatttgtcccgatttttaaggcatacttttcttggggctttaattttcacttgattctattttactatttttttgtattaattccctcacacattttagctattagaaagccagcatgaagcgacgtgtttttgtaaaaaatagatttgcctcaacaaatttttactcagataaagaaagtgaaaattagatttagtttgcaattttgaagtagagattttaaaggtcatttatgttgtgtgcatgtgtgtagtggttgtgtggtggtgtcatttcctttttttgtttgccagaaccattctgaaataaaaaatgagtgcaatatattagaaataaaaggtatctgctctctcataatctataattggtgtgctatttcttaatgtttgttccatagtagatgccatgggtaatcagccataattatggattaagattcatattttgcatataggtaccctattgttccagcagtatttgttgaaaatattggattagaagttttaatgtagcaacaaaattgctgctgtgacatgataaagtaaatgaactgaatatataagaatgtcttctaaaatcaagctttcaaagatggtgtctttgaaagaaatcaagagaaagggttgaagaaagagagtgacatatgtactaaagctatcaatgaatgagtgagagcagatagcaacaaaaaacgattagcatgaagctttgtcttgtggcatgagtttcaaaagatctggtgctttttgaaagaggacagaagactccccaaatggatctgtagaatattgtaatttctatcaaaatgcacacaaggatttttgtggacataggcaagttcctcctaaactttatgtagaaaagcacaggactagaatagctaaaacaaccttgaaaaataagaataaagtagaaggaattactctacctgctattaatgcttactatatggctacattgataaaaaagcaatgtggtattggtgaagaaattgacacatacatcagtgaaagagaatagaaaaagcagaacttgacccctacaaacatacccaaatttttgacaaaaatgtaaaagcaattcagtggaattatgctgagtggaaaaggccaatcccaaattttccataatatattattccatttatataacattttaaaatgacaaaattataggatgaagaatagattagtggttgccaggtttatggaagttggagggtgggaggtggctgttgctatagaagggtagcacaaggaatacttatgataaaactgttattttgactgtagtcatggtcaaagaatctacatgtgttataaaatgcatagaactaaacacacacacacacacacacacacacacacacacatctgttgaaatctgaataagctcagtggattgtatcagtgtcaaactcctgcttgtggtattgtactgtagttacgcaggatgttacctttgagtgaatggcacataggctcttcattgtatgatttcttacaactatgtgtgagtctatagttatctcaaaataaaatgttaaaaaaaagcaggagacagactataaatggtttgatcttcgtcttctattttttttagttcctattgaaaaaaacattgtaagctttcaaatactacatttggatgatagccttatgaaagattttgtggtttgatgcatgcaaattattgctttaaaaacatatgaccagttagtcaacataatcaacttatgttaccaatcagcactataattaagaaataagaacatgataccaaaataaactcaaaatagatcagagacctaaatgtaaaactttaagcaataaaatatctagaataaaataggaggaaatctttgtgaccttgtttaggaaaagataaaattcatagatcagacctcataaaaattaagaaattcaaaaaccagtactgagggaatgaaaagacaaaccatagatagggggacagtatgttcaaactacacatctgataaacaacttgtattcagaatgtatcaaaacatctcaaaactcagtgtacaaacaacccagaaaagtacttacagccagattagctttgcagcatatgtcccctgggccctgcaaccctgtagattgatgcagtgagagccaaatggagacatctcttacatgattgtcagattttacttgttgaatgaggaaaacagaaaaaaatacatttttgtgcttttaaagggaaaagaaaccaacttcccctcttcccttctgagagaggctccttggatatgtaatggaagaaatgcacactctagctctttgatatataaataattctctctaggaaccaaataagttcagtatctccaggtttcacaacatagagatgtctctaaagttctgggaccaatttcttttgaaatataaatacctgttttttgttgttgttgttgttgtttttttgttttgtttttctttttttgagatggagtcttgctctgtcacccaggccggagtgcagtggtgcaatctccgctcactgcaacctccacctcccgggttcaagaaattctcctgcctcagtctcctgagtacctgggattagaggtgctcaccactgctcctggctaatttttgtatttttagtagagacagggtttcaccatgttggccatgctggtctctaactcctgacctcgtgatctgcctgcctcggcctcccaaagtgctggattacaggtgtcagccaccacgcctggcctaatctaaatatttctaagagaagtgaaacaaacattatttatcttatactatacatatttccatgtttcatggacctgcagctttgaaacatgggaataaatccaggtttattttctcacagtgacattatgctaaaattagaatatttgttcctcaatttcagctgagatccaaagatagaacataccaatttgttctagtgtcaactgtattgaactaggagctatgttctccataatctccttaatctgtatacttccagcttagagttggataagagaggaaatcccatattaggaggttaaagggaatcaggggcctttactctcagaaagatctaagtttgagagtcactgacaactacagaggcgctcggcttttcctcactttcctctactccaccagctcttcttcccaactgttgaccttgaggaccaacagcggttccaagcctgcccccagttgcagataacagaggccacactgagacatcttccccatagatccctccacaacctcccttatacagtccctctaaggaagctcaacttgcttgtctactcagatgtcactgccaactcctagtggtcctctgctccagtgcttcaagatgactgtttaatgactttatctgcaatactccaaaacttccctctgaaaattcacctccccagcaattcctactcttgtctaagacaggaacgggcaaagtatctacagtcccattgcttattttttaaaagaaaattttattaaaacgattattcccatttgtttctgtatcatctgtggctgctttctgctatacaacagaattgagtagttgtgacagaagccttcgggcctgcaaacccaaaatatttactgctggctctttacagaaaaggtgttgatgtctgctgtaatgtataattcctataaaaattccatattccattatgtttctcccttcctgactgaaccttcactgatgttctcacttaaataggacatgtaaagaagatggctaataattgatttaagaattgttttttttttttttgagactgaggtcttgctctgtcacccaggctggaatgcagtggcatggtcaagctcactgcagcctcaattgcccaggctcaagcgattctcccacctcagcctcctaagtagctaggactacagatgcatgccaccacacctggctaattttttctatttttttgtggagatggggatcttgctatgttgcctaagcttgtcttgagcctctgggctcaagcagtcctcccgccttggcctccagaaatgctaggattacaggcatgagccaccacactcagcctgatttaataactgttagttcatctccaaataggcacccctaaaaagttttacagaggtttagagtccagtgaacaattggagagggaatttccttgaaaaacattttgttgaacagctgtggcattctcccttgcccacagtttttccatcccactaccatattcttacacattttataggcaagacacagggatattctaagatcaagccttgtcagggagtgggatgagggttggagtagctttaagtagaccacataagtttgatactagagacttgtaactgcagacttaactggcaagagactggctatggtgcctatggcagcaaagtacataattgtgtttggaaagtaactgtattcccatcacaacttcaaaaaggatgcatgtctcccagataatacatatggaacctgatgtagagacatcagcataagactaatttagaaagaaccactttcaagacaacttccttcaaggaataggaggagctcagcaaaaagactggaattgttccattcaatgaagaagccaaggggctaggtatatcctctctgagtctctctttaattcattccaatcaggctgtctgcctacctgctctagcaaagataatcttttctagttcatctggaatatctattttgccaaattcaatgactactctttggtcctcattttactcaacttgtttttcttaaactgacattttattttatttatacactatataatttgttatagatttttattgtttatatttatggtgtacattgatggtttgatatatatgtattgtggaatgattacatcaggctgattaatatatctatcacctcatataaatctgcatctttttttgtgatgagaacatttagaatctactatcttagcattcttaagtatacgctacattattattaactgtaattacctcgatgtacaatagatatccaggcttaatctcctaactaactgaaaccttgtatcctttgatcaacatctccccattccacctgcccaccccagcccccactccctggtagcccctattttccaatctacctctctaagttagacttctttatattccacatataattgctatcatgcagcacatttctttctgtacccagcttatttaacttaacataatgtcctttaggttcatctgcgttgttgcaaataacaggattttctttaaaaaaacaaaacctgaatagtattccactgtttgtatgtgtatacattcatatgtatatgtgtgtgtgtgtataaacaacagataaattgataaaaagtgacatatgtatcacacttgaataatggctactgtgaataatgctccaatgaacacagaagtccagttatctcttcgagatactgatttaatttcctttgactctatacccataagtggaatttctgaatcatatggtcattctatttttcattttttgagaactctccatactgttttctataatggttgtattaatttatatttctaccaacagcatacaagggttctcttttgtccacatccttccaacacttgttatattttgtctttttgataatagcccttctgatagatgtgaagtagtatttcattgtagttttaatttgaatttccctgatgattactggtgtttggcagtttttcagtaccttagcagcatttgagtatttgccatcagtgacaactgtctcctttttgaaataactttattggctttaggaacaccatgttctcctggttttgttgtacctcactttctgttctcaatttcttttgctggattcacttcctctgcctaaactctaaatattgcaggactctgagcttgactctgggcccctctcttctcatcgaccttcttttcataggtgatgttttctgattccacagtttaaaataccatcaatatgctaataattcccaaattgatctcattatcttctatctctcctctaagctctcagctcataaaaccaagcactttaagtctccactaggctctctaaaaggcatcttatatttagtacggccaaaacataacaggctttccaacataggtaaatgttactgcattccattcagttctcaagtcaaagctagagcgtgtttgcttgctctcttcctttctactcaagtcagatccaatacattgtcaaagtcaacactaccaccaccaaagatcacccatccatccttttctctatatttataatgctatcacctaacctaagacagcaacatcttccatgtaaactactagaatcacttcttaacgactttcctgcttctattcttgctcctctcctctgcccaaaccattctatataacaatcagaaacatcttttaaaaatgtaaagcaggtaattttctccccagtttgaaacacttcatattaggaaaaaattcatttcctttaccatggcttgtaaaaatttacttaaaactgatttgatatttgcagtctcttatctcaactccacaaaagaatagaaaacagtatgttgtagctgggaaactgcaaaacattaatatggctgaggataaaggtagatatgtgaaactttggaaggtgatgagactgaaaatatagaaaggatgaaattgaaaaagacttaggaacttagaagttgagactttcctcaaggaatttgaacaataaaatgactatatcaaaaattacacatttttaagaccaactggcaataaactaactttggtttatcaatgataaacagtgcctcagattaatcattttagcagatgttttaggtgacccactcattctttcagcccacgtctgatttcagcaacagctgtggtgaacaatttctgcaaacaatgtcaacttttcatctcaaaagaggcccactctcagcgtttgtgcttcagtgctttcctgaaagcagcaggtctctcaacctggaatgagggacactgaatgccttaagggtgtctggagtcagtagataaatgccctggccacaggtcatgatttccacatatttactcagagagctcttttcgcccacagcactaggcagctggaaaactggactttattgagttttcttctttcactttctcatttaccctgttcactcactcttgcttcctgtaattgcctcccaaatatggcatccaagtccttgttttagactctgcattaggtggaatccaaaaattacagacaatcatgctgttctttattcgagaactattagttgagaataatgtgcttaaaaaaaaagtcattaagacatttcataaaataatggtaaatcttctaagagtaaaactagaaatgtatgggatgaaaagacagataccaacaaatgttaatactagttagtactattttccacattcttcagcccatattagtttttttggtagctatttcaactgacatgaggtggctctcagctgaacatggagttattgtttgctctcagtttcgtatcttatataatagcagtgtcaaaatcctgtgaaatctgagcaatcttcagctgtgaaggacaagggaagaaagtcttttgagacaaagggctcgtaacttggattcttgttttttatatgtatattttgcatttcaagcttcagccacaagcttttttttccccagcatatattttatgttttttctctttctcttacatgccttaatctacttcttcttttgttcaactaaatgtatgccatgttgagatcctcatagcataaaacctttcatttcagagttgtttctgcataattgcctaggcaaatggtattctaccattaaattgtttcactttttattgacatcattactgattaaggaggacaactaaattatgttaggttcaattaagtaggctgatgggacaatccagatgtaaagaaatgctagttatgtaatttttaaaaaagcctctgaaccctcctacactgactacatttccatcccactcttcagcacatgatttttttacagcaaactaaagtttttaaatgaaactaatggttaaaaattaaattatctttttggtaagtcctaaaagtacaagtttagtgtatatacatattgtcacagcaagccaaaatctaagaagaaacaatggagggaaaacatggatttctttgtcttataaactggaagagagcaggtgctttgtctgatttgcttgatacataccaagaagatgctcaataatgatcactcgttatcaatgtgccattggttatcacatcacaaggttattatgagcattctttatattaaataatggatagaagattactaaataccaagcacattgtaagtgtaaaataaatgtgttttccttggtatgccctattctcatttgttgattaatgcagcaatcattgctttatattgaaggttgaaaataaatttaaataaatagtctgtgaactagcgaagtccataaaaaaaggtttagatccttgttgttttgcagtgtggtaatggtttcagctttcttaagctctcctaagtaggtagcagtcatcttacgtagatagcagtctgatggaccagaacatggatatcactaataactctgtatttctgtctcactgtaagcaggctacgttattttcagctatttttgccacctatagtgctctatttagaacctcttagaatgtaagctagcaaactgacaattaaaaattaggtcttaattaagtaagggtcttgtgaaaatttagttattaaatatgtaatttatatgtttattctgattttcttgatgattataaggaaataactatatgtctattcacttcagtatttttaactagttaacagagaaaaaagttgaaattaatgatttacattagttagttctgtttagtatccagaatactttaaaatctcattaaccatattgtatgctatccttcaataatggatccccttaaataaaaaatattttggaacagttgattgctaatgcagaataaatagtaaaacaattgttggtagagattgagctccatataaatgtaagatgacaccatgtttaataaagagttatgcatcccatgggaacacaaaaatatatttcctagattactgaactgttgataaactatgatatgcacatttaataataataaagttagtaagtattttgtcaagtctgtaatatctgcataaacattctgacagagaaattgggagagaaaaagaaaataaagcctttattttcacatttagcattagaagagtggtagactccaccagaaataccaacttgggttgaaagagaccattttgcgctaagcttatattgatgatgtacgtattttggtgtgaggattttgccttgaaggtacatgccagctcgtaggagttcgatttaacattcacctctaagcactgaaaaatctgggttatggtcaacgcagcagcttgctacaaataaaattaagactcacctgagattctatgaattgctttactaaaagcctggttgtttaacattgttgctaaagttctgggaagaaaatccaaacacaacatataaaaataaatttccatggctcctactgtttcctttggaaaggcagataatacaattcttattgccttttatttacagatattgttacaggaaagatagatttgactaaaaatgtcatctaggaaaattttaaccaaaattagaaattttgctagtgatctgggttgctaagaatctaagcattaatacatgatggtcttgtgtaggtaatcttcttcagttgtgatggatgagagcccctgtataggatggggaaggaaagaattcagagaaataagctaatatctgagtaataaatttaacagaaatttgagaatgtccctagataaggctgaagataaaggagaactttgctgctttttagaaaggagtggtcaggactgatggaagaagggagaaaatggaagggactggagagtgtgagaacggttcccacaggctgagattaaggaaattaacttttcccttgaagaaaacatttttttcatggtagcaatgacagaagaactttgtgaaaaatgttatctaaagtccaatttaaggctgtttcatttctggttctgctgcatttttctggcatcatccccccaaaaatagccatgcaaaagtgtaccttgaaaattaaatgggaggtcaagaaagccaaagaggggagaatttagtgagagccagaacctgggaccagaagagagaccaaatacctcttttcactacttaatttcctcaaattccgagagagagagaactggatttatcacagtccactgggtaggataatagcgacttaaaatagacattaacaaaaaggcttatctcagaagtatagataaaagtaaagtacacatttttttgtatgattattagttaggtaatgaatgggtgaatttcttgggctgcctcactaatttgtgaactatgttgcgtatttatttaactctatatttctaccacattcttcttttctttcctgagtgtctctaacatattgatgaaaatgtgtaggttttgacctttaagggaagatgaattttaaggagcagattttaaaaaaattattcaaagtaagtaatatagcttacattttaaagatagtttatagaatatacatatatatatagacatatgtagagagactatatgaaggcatacatacttctatgtgtatgtttgcttttgtagatttgaagaattgtatttcttttattttttaatttataaagaaaggaggcttaactgactcacagctccacatagctagggaggcttcaggaaacttaccaatagtggcagaaggcaaaggggaagcaacacgtcttacatggcagcaggagagagagagagtaaaggagggagtgccacttttaaaaccatcagatttcccaagaatacactcattatcacaagaacagcttgggggaaactacccccatgatccaatcaccttccaccaggcccctcccttgacatgtggggaaaacaattcttttttttttcaataggttttgggggaacacgtggtatttggttacatgaataagttcttcagtggtaatttctgagattttggtgcactcatcacttgagcagcctacattgtacccagcgtgtagtcttttatccctcaaccctctcccaccctttccactgagtcctcaaaatccattgtatcattcttatgccgttatgtcctcatagcttagctcccacttatgagtgagaacataacgatgtttggttttccatttctgagttacttcacttaaaataatggttttcaatcttatccaggttgctgcaaatatcattatgttgttcctttttatggtgagtagtattctatggtatatatgtaccacattttctttatccaattgttgattgatgggcatttggctggttccatatttttgcaattgcgagttgtactgctataaacgtctgtgtgtatcttttccatataatggcttattttcctctgggaagatacccagtagtgggattgctggatcaaatggtatatctacttttagttcttaaaggaatcttcacactcttttccatagtggttgtactaggttacattcccaccaacagtgttaaagtgttcccttttcatcacattcttgcccacatctattattttttgatattttgattatggccattttggcaggagtaagatggtatcatattgtggttttgatttgcatttctctgataattagtgatgttgagcattttttcatttgtttgttggccatttgtatatcttcttttgagagttgtctattcatgtccttagcccactttatgatgggatttttttcttactgatttgtttgagttccttgtagattctggatattagtcccttgtcagatgcatagattacaaatattttctcccactctttgtgttacctgtctactctgctgattatttctttggctgtgcagaagtttttttactttaattaagtcctatctatttatctttgtttttgttgcatttgcttttgggttcttggccatgaagtctttgaataagccaaggtctagaagggtttttttctaatgttatcttctagaatttttatggtttcaggtttcagatttaagtctttgatctatcttgatttgatttttgtataaggtgagagatgaggatccagtttcattcttctacatgtggcttgccaattatcccagcaccatttgttgaatagggtgtcctttctccactcttatgtttttgtttgctttgtcgaagaccagttggctttaagtatgtggctttatttcagagtccactattctgttccattggtctattgcctgtctttatacaagtaccatgctgttgtggtgactatggccttatagcatagtttgaagtcaggtaatgtgatgcctccagatttattctttttgcttcatcttgctttggctatgcagggtcttttttggttccatatgagttttaggatggtgttttctagttctgtgaagattgatgatggtattttgatgtgaattgcattgaatttatagattgcttttggtagtattgtcatttttacagtactgattctacccatccatgagcgtgagatgtgtttttattagtttgtgtcatctattatttctttcagcagtgttttatagttttccttgtagagatctctcacccctctggttatgtatattcctaagtattttatttcctttctctgcagcaattgtaaaagtgattgaattcttgatttgattctcagcttggtcactgttggtgtttagcagtgctactgatttgagtacattgattttgtattctgaaactttactgaattcatttatgagatttagaagctttatggatgaatctttacggttttttaggtacacgatcatatcatcagtgaacagcagcagttttactttctctttaccaatttggatgccttttatttctttctgattgctctggctaggacttccagtactatgtgaaatagaagtggtgaaagtgggcatccttgtcttgtttcagttctcagaggaaatgctttcaacttttccccattcagcataatgttggctgtgggtttgtcatagatagcttttattaccttaattatctgccagttttgctgggggttttaatcataaacgttaatctattttaatcataacgggatgctggattttgtcaaatgttcttctgcatctattgagatgatcatataatttttgtttttacttctcttgatgtggtgtattacatttatggacttgtgtatgttcaaccagctctgcatccctggtctgaaacccacttgatcaaggcgtattatctttttgatatgctgttgaatttagttagctagtatttcgttgaggatttttgcatgtgtgttcatcagggacattagtgtgtagttttctttttgtattattctttcctggttttggtattagggtgaactgcttcatagaacgatttagggaggattccctctttctctatctcttggaatagtgtcaataggattggtactaattcttcttttaatgtctgatagaattcagctgtgaatccatctggtcctgcactttttatttgttggcaatttttaaatcaccaatttaccactgctcactgcttgttattagtctgttcagtgtttctacttcttctggtttaatctaggagggttgtacatatccaagaatttatccatctcctctaggttttctagtgtatgtgtgaaaaggcattcatcgtagccttgagtaaacttttgtatttctgtagtgtcggttgtaatatatcctgttttgtttttaattgagtttatttggactttctgtcttcttttcttggttagtctcactaatgttctatcaattttatttaccttttcaaagaatcagctgtttgtttcatttatgttttgtattttttgttgttgtttctatttcatttagttttgctctgatcatgtttgtttcttttcttctgctgggtttggttttggtttgtttttgtttctctagctccttgaggtgtgaccttagattgtctatttgtgctctttctgactttttgatggaggcatttaatggtatgaactttccttttaacactgtttttgctatatcccagatattctgatagtttatatcactattatcattcaattcaaataatttttaaatttccctcttgattttattgctgactcagtgaccattcaggagcaggtcatttaattttcatgtatttgcgtggttttgtgggttccttttggagtggatttccaattgtattccactatggtctgcgagagtacttgatataatctcaattttcttaaaattgttgatacttattttgtggcctatcatatggtctatcatggagaaggttccatttgctgatgaatagaatgtatattctgtggttcttgggtagaaggttctgtaaatatctattaagtccatttgttcttgggtaccatttaagtccattgtttctttgttgactttctgtcttgatgacctgtctagtcctgtcagtggcatattgaagtctcccactattactgtgttgctgtctatctcatttcttaggtttaatagtaattgttttataaatttgggagctccagtgttagatgcatatgtattttggattgtgatattttcctgttagactagtcctcttatcatcgtatattgtccttctttgtctttttaaactgccgttgctttaaagtttgttttgtctggtataggaatagttactcctgctcattttggtgttcatttacatggaatatctttttatacccctttaccttaagtttatatgggtccttatgtgccaggtgagtctcttgaagatagcagatacttggttggtgaattcttattcattttgccattttttgtctttcaagtggaatatttaggccatttacattcaacattagtattgaaatgtgagactctagtcaattcattgtgccatttgttgcttgaataccttcttttcatcatattgttttacagttcctgtgagttttatgcttcaaggaggttctattttggtatattttgaggattgtttcaagatggagagctccttttaacattttttatagttcttgtttggtagtggtaaattctctcagcattgtttatctgaaaaagaatgtatcatttcctcatttatgaagctcagtttaatggatacaaaattcttggctgaaaattgttttgtttaagggggctaaaaataggaccccaacccttttagcttgcagggtttctgctgagaagtctgctgttaatcagataggttttcctttatagtttaccttatgcttttgcctcacagctcttaagattctttatttcattctgactttagataacctgatgactaggtggtgaagcaatgacctttttgcaatgaatttggcaggtgttctttgagcttcttgtatttggatgtctagatctctagcaaggccaggtaagtttttcttgattatttcctcaaatatgttttccaaatgtttagatttctcttcttcctcaggaacaccaattattcttaggtttggtcatttaatgtaatcataaacttcttggaggctttgtttatttttttaaattcttttttctttgtctttgatggattgggttaattcaaaagcctggtgtttgagctctgaatttctttcttctatttgtttgattctattgctgagactttccagtgcattttgccatttctctaagtctgtacttgatttccagatgttgtgattgttttttattcatgctattttactggagatttttccattcacatcctgtatcattttttttatttctttaagttggacttcacctttctttggtgcctcttggattggcttaatagttgaccttctgaattctttttttttttttttgttaattcagagagttcatcttggtttggatccattgctggtaagctagtatattttgggggtgataaccttgttttgtcatattatgagaattgtttttctggttccttctcatttgggcagactatgttagagggcagatcagggactcaagggctgctgttcagattcttttgtcccattgggtacttccttgatttggtgctctccccctttccctagggatggggctttctgagagccaaactgcagtgattgttatttcttttctggatctagccactcagctgagctgccaggctccacctggtgcttgagagtgtttccaaagagtcttgtgatgtgatttgtcttcaggtctctcagctgtgtatactaacacctcctccggtggaggcggcaggggagtgaagtggactccatgagagttcttggttgtatttttgctaagtactgctgattttgtgttcgttggcctcaagccaggaggtggtgctttcaagagcacatcagctgcagtagtatagggaggatacaagcttggcctaggatcaggcggtgtgtggggccatggagctcccaggagactatgtcctttgtcttcagctaccagggcaggtagagaaagacaatcagtggagggcagggttaggagctcagactctccttgagtggggcttgctgcagctgctgtgggggatgagggtgtggttcccagagggattatggctgcctctgctgcctcacacaggttgccagggaagtaggggaaagccggcaacctcaggcctcacccagctcctatgcagcctgcagcctgaaaggctgatctcactccctctgtgcccctgacaacaggactgagtttatttccagggctgagaacttaccccaggttacaagcctcctagctgagaaagaaaagggactcagctcctctgctgccccacagagcctgcagcaacaatccatccacttcaaaaagtctgtggaagttctcagctttcctggtatgttcctgccgtggttcttggagaaaaggttcacaatttgggtctccacacactgtcctgcccatccaagtgggagctgcaagttagtcctgcctcctatctgccgttttccagaactgtatttctttacccactcatttatttgctgtttcctatattttgtacaaaaatgactaaaaattataactaataaaggttattttcctacatcttccctcttccaaggctttttcattgttttcgttaatgaattttttttgaaaaaagaaatgaatattatgttaactataatattaattttcagaaggatagtaagaagacgagtcccaaatcccaatcctcagaaataaacactgttaacacttgatggacataattacagatatgtctgctggtgtgctggaactggcttgtactggcttctgagaactaattgtgtgcatcttgtcccagctctgtacccagggacattacattagtagactgaaatcagtcatgatgggagtattaacaccacggaaatagactacactcagaggctctttttgtgttgctgttttttgttgttgttttgaaagccatttactaaagatttgcaagcccatacatcactgaatatatcactatgaacagatatagaaagacagctaaacattttctataaggagacagacaaaaattacctcatggtctacattataatatttaattaaatgtattcaatttaaaaatatttttaaattttagaagaaagagaaattgaagtgaaattaaaggaattgctaaattctggctggtggggagaggcactattatgggccctatataagccccagtactgctcactcttatcatttagggagggagaggacagttcactttctgtgcagctctcacctttccaggagtctgtcctgaagattttagctgccttggtgttcctggactttcaactgtctctttaactcagaaagttcacggggcttagctcattctctgctccgtagcctcaaaactctctcaaggcagtaagctaggcaggcagccatggggctctccttatttgttttccaactctcagtcatgagtgtcatttctacctgatgtctagtgttttagaaataattgtttcaatatattttgttcattatttgtttgtttcaggtgagagagggaatccagtttctgatatcccatgtggatagaagttctaaggatatgtgtgcaaatataaagtcttttttcaaattatgttgatactgtggatagtttaacattccttccaataattccctacctttacaaaggtctgataaatgccagcaaaatattagatggtgaaaccttgataaaatgaacggtaccaggtaaatattggtaattttaaaaaagatgaataggccatgacatctgttttgaacctaaagctgaatatcagaatgaatcttctgcttttgtattagcatccatggactgtcaagcctttacattttattagggtaacaataatcaacactgtatttataacatgcattcatgatcaaacatcatatttaataaatgctgttgaattaatgtagttttgtttagaaatgcagcctgaataaagtattacaagacaaacataaaattacatttttaatgtgcagttttgataactgtatattgttaaatatatatatacaattttgaggagaacacctatctcaattaaaattcttttcgagcatctacttttaatattgtatgaaggaagctacatcagtatcaaccaagcctcttttctttagaaatgtatgattttaatgaaatttaccaacctggggattgtgacaactaattaacatcttacttatatacactagatatttctgttcactcagttgtatattcatgtattcaacaaattgttttatacagatgctccttgacttacaatggagttacgtcacaatgaaatcatcaaaagtctaaaatatcataagtcaaaaatttaataccctgataagctcattgtaaaataaaaaaatttaagtaaaaccatcataaattgaggactgtctatgtaatacaaatattctgccataaataaaatattgttaaaagtttaagttgttctatagacaatttagaatgtaaaataatgcttataataataataaatgttctatcaggtattatagaatactagatggtcctacattttagttttctagataattgaagttttccctaaatagaatcaataatttccaaaagggttacctacttaccacatatctttctaaagtacattccatgtattttgttctttctacatagggcaaacttttaaaatttatagtttcactaataattcagtgtcaacacttgcattatcaaataccgtttttgtggctataatatattattgtctttagaaaatgtgtgaaattgatgttccctacatgaaattttccaagactttatgcctttttaaatatgtcagtgttttatagttttcctctgtctttctttattcaggcttttatatggcccttttctagttctgtagtgattctgtcttcatcagcttttcctctctcaattctaatctattgtgaccagctcataaggtaaccaagctaattagaataatgagtttaataaaattggtctgtgagtaatgccttaaaatatggactttatagtaaaagcttcactgtagtcttttaactactggagacttttccttgttttcttcctgcttctggattcttgaattgaaattgttctttgaagttttacatttaaactgcactttcacatctagaagaaaaatcacatctgtaaactacacccaagtccagggtgataaagccttaatctgaaagagaccaccatacttctgagatgtatctaataaatgtttagcttttcaagaagattgtgcagaatatacaacccccaaaatacacaagtgggaagagtgttttcaaattacctcatttgttggttgttgatgtaatttaatgaactgcaatatacccttcagattaggctcaaataacttaccttcttggaagcaatttctgacctttcagatagagctgatagattcttcctttatattcttcctacaccacaaattttttctctatcttaatcccattatatacatatttgtttacatacaagtcttgctttttagattgaaagtttccagatgacaagtagagtaacttaaagaatctctaagccaagcacagtgccaacataaagtaagagctcaatgaatgtgcattgaatagatggatattccctttagcaattatggaaacaacatgatattttatgaaatctatgggattaaacaaatagcatataacgtactgtgttatgtgactaaggtcacaaagatgagtaagatataagcccttactgtcaaaaactagacatatgtaaaaagagataaaatggtacacaaataaccgtggagctgtattagttgagataggccaagatatgctctagttcaagttggtccaacctgtggcccatggactgcatgtggcccaggatagctttgaatatgacccaacacaaatttgtgaactttcccaaaatattatgagttttttttgtcattttttttctttttcagctcattagctatcattagtgttagtgtagtttatgtgtggcctaggacaattcttcttcttccagtgtggtctagggaagccaaaagattgggcacccctgctctagtgagtaatgagtaaaccctcaaatctttgtggcttacaacaatagaattttctttctgcttcatccaagttggaggtgggctagaaactttactcactcctctccgaaccatgacacagggatctgggcttcttctgtcatgtatctgggccaactctgagtctttgcctccaagaaatggatgggagagacagacagagggaaatgggcaattacaatataccgttccatgaggagccagtttgaaatagacatgtgtcacttcttgtcacatttgtttggccagaacttgctctattactctgtattggttcaaggggctcagaaatatattcttcctgtctgcctaggaggagaaaaacaaatggtctgattagcactgtggtatgcagcatacagtattgcctctagctcagttgccaagtgcaagtatgaagtcaatatgtacaggcaacttataaaggaacaatttacttatataatacttcaacttatttcttatcactatactccaagatgttttcctgacgtgtcattaaattacaagtataaaaacctctctttagacaagaaagcataacaatcacatgcatcttagcactgctgagcttttatttcattcacctcctgataaattgctgtttgtaaatattgtgttaatgtctgttgagaccagaacaatggatctggtaaaaaattgattcaattaagagataaagaatgaagtttaccattattttacctttttggtgacaccaatagaaccatgtatttcgtcattcttgcattgctataaaggaatacttgacactgggtaatttataaagaaaaaagatttaattggctcagggttctgcaggctgtacaagcattgcactggcatctgcttggcttccagggaggccttggggagtttttactcatggtggaaggcaaagctagagcaggcatatcacatggtgagaccaggagcaagagagagggggaggaggtgccacaagcttttgaacagctcgatctcatgtgaactcactattgtgaggaaagcaccaagccatgaagaatccaccctgatgaccccaacaccgcccatcagtctccacctccaacaccgggaattacatttcaacatgatatttcaaaggaacatccaaagcatatcaaaccatttcttaaaaaaaacttggcattttattactttactatggtttagtggtataattctttatgctactatccctagagaacagacatatgtgctgtgtatgtgtcacacacacacagaaacacacaaggggcccatttccacacatatacataaatatcagtggtcttggcattgacccaatgtctgaatttgtaccttcagacatatgggaatattttcatctctaaaaatcattttgtacattaatgtttaaattatagcttcatatttgatataaaaattctgacttctaacttaatatgtggttattatgctgctactcagtgaatgtattttcaacatttaaacattttgtccttcaaattattaatcatttttcattctaaagatgactataagaagtacaagaaaaacattatagaataaaagtacgtatgatttggtctccatattttacaaatgaagaaatggcttactactggctaagacaagaactcaagaattgtaaaaaaaactgtataggttttggattcagacacacctggattcaaattttggctctgttgcttaatttctgtgtgaatatgtataagctacttaatcttcctaactttcagtctttttatttataaaataggtgttacagtacctgaatttcagagttgctgtgattagatgaaattagataattagatgaaagaagaagaaagaatgtagctgtataaaattcttgttatcagcagcaaatttctgactctctgataataataattggatattcttatactactactactaatactagtactattatcagtttctttctaaagtccttaaggacttatcagagcaacttcaaactaaaatagaatttaaaagtgtacttttctttttcatttgaatactattattaacaggttgagttttggcaaatagtttccctgttaatataatttcttgaatttgacaagtataacaaaatatgttatctgaacacagtggtaataacataataattgaacacatcacagagcagagaattaaaatgatgtagacttcagaaatttcttgtattgttagaaaaacgaataaatggcaagaaaaggatgatttattgtatggctgttatctttttaaatcatcttggtagaaggtataggaagtatctttctatgcattttccatcatcatgggttcatattgagagaaatcattctattttttttgtcaatgatagtgtctcattgctaaaacaactgcttgaaaacagttttcaaaaactagatttcactttaaagaaaaaataaaaatctacactatttccacttatttacattttaaataataaaattacgttaagaaacaaaacaaaataaatacgtttgccaaaatctatctgtctttgttcttcacatcacttcattttattttaacaaatttactgaggtaattcacatgccatacaattctcctatttatgcacattacttcttgaataagatattcctatgcctatccaatctaagaatcccaagaaaaatcaaaataaacatatcgatattgaatatcaactctgtaaaaacgatcagaatagactagaataggtgctggggtgagacaattatttatatgttttttctctcaaggtattaactttcaaattagaagaattggacataggtacattaataaaatatttaaataaaatattaaaatatgttatatataatagaagagatactataacatactcaatgactaataataaaataggggtcataaaataaaagtgatttaggaatttcaaggaagaatatatattttacactatattagttgataaaaatttcctagatgagataaaatttaagttaggagttcagagaaggccagaagagaaggggagttttcctgggtaaaggggaaagaaggggtcaaaacatcaacaaaagcaaaggagtagaaaaccataagactccctcaaggagcaatatgtgaaaaataatcagctggaacagagtgttgcctttgaggagaattataatgtattctccagctgggactcatgggcaaggttgttagccagaagatatacctaagcccatccaatctaagaatccaaagaaaaatcaaaataaacatacaaatattgaatatcaactctgtaaaaaaggttagaatagactagaataggtgctccaaaaagccacaggatatgcagcatagcttatcatatggaaataccatatttccttgggactaattaattgaagatgtgatttttgtttttgaaaactcatataaattggaattttatgtcattttcaagtgtttcagctgctctccttaaaaatcatgagtatgggtttattctccttaatcatttcagctttttagtggaaaaagctgattatcaagaattaaaaaagacaagattacgagatcaattgggtcctgttggtggaaaaacttaaatgtcagattaaagagcttggactttgtgttagaagtaaggagccttagaagaatgctaaactgtgggaaagtatactaaaaaatctttcaataaattaatatggcaacttaatatacaggatgtatgaatgaggaaattattattattattatactttaagttttagggtacgtatgcacaacatgcaggtttgttacatatgtatacatgtgccatgttggtgtgctgcacccattaactcgtcatttacattaggtatatctcctaatgctatccctcccccctccccccacccacaacagtccccggtgtgtgatgttccccttcctgtgtccatgtgttctcattgttcaattcccacctatgagtgagaatatgcggtgtttgtttttttgtccttgcgatagtttgctgagaatgatggtttccagcttcatccatgtccctacaaaggacatgaactcatttttatggctgcatagtattccatggtgtatatgtgccacattttcttaatccagtctatcattgttggacatttggcttggttccaagtctttgctattgtgaatagtgccgcaggaaacatacgtatgcatttgtctttatagcagcatgatttataatcctttgggtatatacccagtaatgggattgctgggtcaagtggtatttctagttctagatccctgaggaatcgccacactgagttccacaatggttgaactagtttacagtcccaccaacagcgtcaaagtgttcctatttctccacatcctctccagcacctgttgtttcctgacttttttatgattgccattctaactggtgtgagatgatatctcattgtggttttgatttgcattttgaatgaggaaatattataggctgaaaccagcttagaatgtgcaaacacaaatgatttattaaggcagttgcatcattttcagagccaattctattatgtgatttataaaaattgtttaaggtctgctacagtttgaatgtctcccacagaatttatatgttggaaacttaatccccaatgtgacagcattggcaggaggagccaaatgggaggtgtttaggtcttgagggcaggatataaatggctgtcaaaagaggatttgctctcttgtgcactttgacctcctgccttgtgatgacacgggaagaaggcccttaccagttgccaatgccttgatcttggactttccagcctccagaactctgagggaataaatttctttttttttatattttactcggtttcaggcattttgttatagcagcacaaacgaattaagccaaggcccattgtccttgactaattcttgaagattagagggctcacttcattggagtccaatattgctaatttaaaatctaataattgtatatcatcaaaaaaaatctgtgaaggcaataaactttcctttatggaaataaaaaagacactaaattagttatgccatatcatttcaaagttgaactaatagaaaatgttacccattaatgatttatgttgtctttatcagaaacaaaaaatgccttccaaatacattttatcaaaaatcatttaagaaatacatctcgttttatataagaaattaaagtgagtctaatcccaaactattataaataacaagtgttgatctcctcctcagtcctccaagaaacagaaccggcaaatttctgaaattgttctaaaaaaatcagtgattatttcaaaagctggtaacagtttttgaagattagcattcttggtggaatatttaatgagcagtttagctgtagttccctagcaaaatgaagaagtccagaaattgtgaaaaacatatggaggcaaatggcaaggttcaccatcccctgcccagtgggatctcagctacatccatgtgatccctcagccatatttaggtctttcgatttctgcagatgaaagaacattctttcacaagaaatagagaagctaccatgataataaaagctctttgggtgccccatcagatgtaagctctccttgatgatgatgtcgattatcatcctgttatttttggcatttattcattttctctcaggcatgggactttgcctcataataagtaggagggcctcaatttcttgaagctgccagagcaaccatattccaactatcatttttttcacaaatgcttacaagataatgtatagtgaacttcctggttgagaacgtgaaatgtttttgtacatttctgaagaatggcaaactacctagcttaaataccccgtgcctaatttccactaacattgttcaagagtcaaacctcataaaccccaaagcatatatagctaagggtggaataaaggtgggctcagaatgcttaaagcccgttatgtcccatgttataaaggactcagaactaacttctacccctggtactttccttatgcttctcttaatgaggtctttccaaaagatataggtgtcattaactcctggaaatcaattcttccttcaatattgttgcaggcattaaaccagaagtgactattaatatcaaaggaatatttaagttacaggagaattagtatgaaatatacattcatatacattaatatgaagtatacactcatagggtattgttaggtgccataggaaattgagaaacctgttatctttccacaatccaaatatttaagaattaactatagaaacatatgtacataaagaattgtaaacaacagtatgacaaattttctatcaaattttaaaaatgtaggaagtaacgacaatctaagtggtataatgcatatttaatattttctagggatgtatgtatgcttgatatatttaccaactttgatttttcaatgtaatatatacactttgagaagtaaatttaggtgttcataaattaaggagaaagtagccaataaaaatgaagtgtcagtttcatttgaatagggatttttaaatgaataatttacaatatgtagagagagttataaaacatgaaaaatatttcaaatagtataaaatatatgtgaatatttatatggtgccagaaagaatatcttagaagaaatacaaaggaaataacctattttactacaaaaatatgaacgttttaaaacccaaaacaaattaatggcttattgctagctggaaatttctatgcactctggaataactatgaagcaagaccaacattctaggagaaaattatcagtatttgttaagagcagaaaaatgatcattttaaaaatatattaattctcaatctaagagtattctagagagtactaataaatgtaaggaaagataaaacatcaaaatatcaccttaatacaaaaaggagtggaaattttataattgactaacaccaggttataggttaaattaattgtgctacatcttataacagatcaagagtcaccattgaaaaatcattcttgaaaagagcatatcttgctgtgaactttgaagagactatttatttatatgaacaaatacaatataaccttaaatgacatcaaggaaaaaaaaactatttttcagtacaattccaatttcaaaaccttaaatataatgaatgtcacatgctagactattcctagatactcttgcgtttggggtttatcctcctaataattatgtaacaggatgttataacactatcgaactaccctggttttagtttcagctaaagccccaagactattattgagaccaccatacagaaattgtaaagaggagtcattaacccttattaggaacacttagcctgtgaagataaaaagacccaggattagagagaacagtttgttgatgtgtaatgagtcctacacacttgtaagatggaggggtcagtgtgcttgcccttcaaatcatgctttaggaaaggggattaaaggagatgtgcaaagagtttaatatacaagccgaatactttggagaacacagtggacttgcgtctgccttacagacacacctgagacatctaacatggaaggatctggttggctggtttatgacagcagagggaaggagagttggtgtcactcgccaactgacactcctagagtctttctggacaaaagatgcattagtgttaatggcgaagctagggatgagcgacacatgtgagtgagagttaactttggtactctatagtgaggtgaattgtcagatttctcacggccaaggaaagagccagcagcagccagagatgaattgccccgcatgaagagaacgcttgttaagaaattcacagcaataagttggtatctccaaagagctataataacactcagaaaagtaagggtcagcttaaaactctgtccattcccaggaacacctcatgacaacccgaaaaagagaagtaggactttccctgcctctttctgccactctaaacttgctcacccacaatcctggtgaggatgggagctgagaatgacaagctggagatgaagatactgcagagtaagtcaggaaagagaaaagaagccaacggggcatccttgttggaaattttacattttatttattattaggctgaacaaattcattactataccatttttattattagaaatcaattagaaaactagtacgatttattccatccaaatttcacccaaaggaaagggagaaatttagcttcaaatattagacttaaaaggttagcagcatacaaatatagttgctttcacattgaatatcacgtcatgcttgatcaatgcagctgctatataaaaataaagttgtccccatttcttgtattttagagaatccaatatctacctatctcccccaccacagtgtgcccaggattttcctggatatagatgattttattcctgttcctgcctcatcacttatagctgtttatttctctctgcccagcactaattcaaacattacaatacaagtcctctaccttgatatttaaaaaatatctctcacaaagggagttatatttaatagactcctgctcacaacttggggttataggcagggtgggggagtacttttttgtgtattataaaagttagcataaaattaaatataaggcacactagattttagaaattccttggccatattcacctcactgaacttcattctggttagttttcaaccctcaagttgcccaattcccggctgtgttgctgaccttcacaatcctgggagatcatcctatatgtttcccaacttttccagtattagttatggggcctgggtcaggttacttagcatcttcctatctttctttccttttcccttaaattgggatactatgagtagctacctcacaggattactgggaaaattaaatggactgacatgtataaagcaattagcttagtgcctggtacagagtttatgtttcataaggtactcagcttgcattttgtttcttctactcatcataagtatgccctagagggtaaggtagaatgggagtggtttccttcttacatgaaaagaactcctcaaaatgttttcctaagtgaaacagttctcactcccaatacaatgagttacctccttgaaaataatattattttcctctcctggacttgtatgtcaaaaaatacagtcaaaagaattgtatgaaatagactaaaatattatttatgtgtatttctggatataaagttgtgaaagttatttttatgcatattgtattttatatatcaaatctgaatttcttttctaaaaacagagatcttacttattaccaccatgccttactaacaatttcatgaatataggcgatcaatgaacttaatcaaagaaggtctgggacattgagagtggtgacttaggaccctccttcctacattagatgctcacttctggcccagagcaagtgatgaggcctccaaggagggttttgcagtgttatataccacagcagagtgagggttcagtctataaaatatctctattttatacagtttgtatgacagtttccagggagtcatgcctcataaattcatatgttctgtatttatttataagcaatacttagggatagcctattaaagaattaaataaagaaggcttatcctagtaaatatcattagtctaccttgtggttcaattattatgttcacaagaacattcatttcaatcatcagtcttcttttcatttcccctgggtgcaatctcctggtattgggggagaaatagatttctggccagttgctttaacagcatctaccaattcactgtctgaactcagttaatatcttcttgccacacatttctctagttattattatttgttttactatattttaacaaagaattaaggcatctaataccttaaaaaaccccaaaagaattggaggaaatagactaaaatattatatatgtgtatttctggatataaggttatgaaagtttatttttatgcatattatattttatagatcttgttcaaatcaacaagattttaactacctaatagggactatgaataaaatatatccatagtgaaaatatttatttaaaagtcttttgatacatttattccatttaattagtgtttatcttcaattgcacattttatatgatttgatggagacacttaattgaacaatgcaatgtttataaggtcaaattcactttcttctctggacaatccattttaacatgtttttaatcaatgggaggattcaatccaacctctcaaagtgtttccttttcctgggaagcatcatttgcataagtctagttttcacttacttatattaataaattacaaaccctctaatacaccttgtagctatgatagagagattgatgtagtgtttgacacaccatacattagtaaaacttacagtatcaatcagggcaatgtgtctcttcttttctttagattacagattactaagaacccaatattcctttttcagagaaaagaagtccaaggattttctttcaatattggccattagtcagcacccagatctgagagagatgtccaacagtgttattcttgagcttatttattttgcataactgaaactttattccaattgaagaactcccatttttccctccttttaacttttggtaaccaccattctattttctgcttctaagagtttctcatacctcatatgagtggaatcatgtagtatttgtccttctgttgctggtttatttcacttaacggtaatgtcttgcacattcatccatgtcgtgagaaatagtaggatttccacagacatttttaaatgattttctctgttgactgactgtggggtgcagtttcttatctcattagccagtgcatggcctgagaacccagtgcctgctcacttcaagaagcagataataattctggaaatctgactaaagcatctgccttattccaaatctcttctgagtcaacaactagttatttctggtagttatgtacatgacacacttgaattcttccctaaattccatgaaatttgttgttgttgttgttgttgttttttaatgaatgcccattcccttgacaacaacaacaaggccattggctataagtgaaaagtctttgaactgctttcatctctgtccaatgtgcaggtgtgcccttgtcttcttccattaagctttccccatctgcagggtgtattgccgttgttttccaaacaagtgacataatccagaaactctcatcagtgaaccagacaacttactttgcttcatggggagcaattcgcaagacacagaacatgcagcaattaacctggaaaagtctgctgagggctttatttgatcggctctatagtcagtgaggcaacctgcttgatatggtttgactgtgtcctcacctaaatctcatcttgagttgtagtttctatagtccccacaagtcatgggaggtgcccagtgggagatacttgaatcataggggtggttacccccatgctgctgctctcatgatagagagtactcatgagatatgatggttttataaggggcttttccctttttgctcagcacttctcttgctgctaccatgtgaagaaagacatgtttgcttccccttttgcgatgattgtaagtttcctgaggccttctcagccattctgaactgtcagtcaattaaacctctttcctttataaattacccagtctcaaatatgtctttattagcagtgtgagaacagactaatacactgctcctgtatgcagtgattcccttctgtgtacttgcccacttcccaaagtatgctttttaacatcccatttctaatttctgagtgaactttggctgtgctgtttgatccctatatgaatgtttctgacatcatccaagacaaagttggtttccctagctttggagttatctgatgcccttctgttagggcacagttttgatgaccaccactcagtaagaagcaatcaattgtcttttaaatggtttattaggaatagctattttgcctaacatttgttctcaaaaaataagaggtcttcactgaactctttcatttctgcagatagctctagtctgtgtatgttctggtttcgggtgcatctaatattatctgtgcagtcaaatcatacaatcctaatagaccttcctgcatcaccaccctccaaaaatcctttagcaatttcttctgctcagagcctctactcaaattcagttatctttctggtgactttgtgaacagaggtcaatagcattcttagattgaagaaaacaaaaacaaaaaactgcaaaagcctaagtaagctctatttatctctaggtctcttactcatttgcagattctgtaagcgataattttttatggtttcaaaaaatgtctctagttgctccagtcaatgtaattccaagggctatggatattatctgagctcatcagcctggctctatttgtcatgtgagtcaccacagtccttaactcctctttaattcttatgagaggagaagcttttataatataatcaatttactaacttgctttgcatatttgttaagtccaggtcccacttcatgaaattatcaattgtgcaggcaaattcaaacatacttctggcaatatagtaaatgtatactgagtcctattctgtgagaatgcatattgtacctggctgttcctggaaattgagatggagaagaaagcactaggcaagtttctaatgacatagccatcctccttggcttgttgtgcatcctatacagtgtttaccacatcaggtacagttgaagcaattaggacaactacttgttgaatgcttgataatctacagttaaccttcagggactggccagacagctctgttaatggggaagctaatgggaaccaataatcatacctcaagtattcccttaatcagggcaataatctcttgtacgttcctggaattctgtattgtttacaatttattctaggacaacataggaaattccaaaagtcaccgttcagcatggccagttaaaactccaggaagggtgattaggcaatatacttccccaacaaaaacggaaaaagggaacattctctattagcacataatatctatcccaattatgcattcagctaaaggccattaaccagtgaaaagtctccccagtcatattcttcactcctaaacttattctgatgctagtccccccaacatggcatctccaaatcctgctagtttcagctttgggtctttcatagcactgccttgatttatcataagtgctactgaacattgaaaacctctatctagtcattttagaggctttgcctaccagttcctggcttttttaccaggatttgctggatttttaccaaatatttgcaaaaggcctatgattgcttgtttggggtaggataagaatatctcagtctctcagccaacctttttcagactcaatgactttatctatggaaacacattcaggctgctgtttaagtactttccattttgaatcttgattctcatcagttgatttgatttttctagactataataatttgagtgaacttgcagtgacactttaagaagtgggagggaggatcagagcagctccccaccttccaaatgtggatactgttgttctaacttcttagtagaaacagtaagattctttctctctctttttacactgctttttataaaccatctaaagagctccactaagttgaggggattcttatttcctttttctcttcatggtcctttcttttgtgtgcatagatctttttatcatcatgcagccccctctgcattacctgagctggcaggttcatcatcatctcctaaatattcccttggtttcccattacataaggagaacaggagacagaagctctccaaagtagcacgtgtttcattatctgtgccagaaacattaaattgattgcgtctttctgatcatcaaatagacaggttggtgttggtcattcacaccatgcctgaagcatgaaaagacatatgacacttgtgagtcatatgtctcatatgtctcacaatgagtcatgttgtgagtcatattgtgacatctgtgagtcatgtgtctcatgtgtctcacaatgagtcacattgtgagataggaaattacctatctcacaggggaggggatagggaatttacccctctcaggagagggttgctatgcttctacttttaccggttatatagattaattattataccacatgaaaatacctgcttacagaagttttcagacactggggattagccttcaacttacatagctctaaaattagtgaaatttcctagacaggtgaagaagccctgcaagtaatgatttacctggcttctactggtatttttatgtaaaacatttgaaaatttacacagaatatccttgggatttagtagtcacctgatcttaacctccagttatttgtgtattttttgagtaatcaatggccttgtttatgctactttgtgaagaagtgggacatcattccaagtagtcatataagtacaagtatgccttccatgacaggaaagaaaaggctcacagcaaagaatagtagaatttggaaattttttttcttaggattgggtaattataagcaatacatagattttattgttctttgcttgaagggaacttataggtcttactttatcagcaccactagcactagccaggggatagaaattgttctatcttcccctcttccagccacccttcatcaatccatttagccatttccctcatatctaagtgtacttcctccacattccattgcatcaaagatttgctatcatcaatgtcctatcatcaatgggtaggactcaacttgtaattagatcttcactatattttttatatactttttattgctaaaaatgacccagcccattaagatttatgagattaaagcatagttctgcttgcactgccaatctgtgctaacacaaagtctcagactggcaaagaaacatggttcaaaagctttaccagttctgaaatgtactaataatttcaagaatacaggcaaccaagaggctcagacagccctggggggttgtctgcgagtagaccagttccctggcactttccatgtttgagatgtagtctcaggttcgaatagaagatgaggtctcctggtggagttttgcttggttgactcacacagcagaggaatatttagtctataaaatattgccaccttatacctcagtttaagggacattttccagggagccaagtattataaatccttagggtcttaatttattaatgttttctacaggcaatcctttaccagggacattctgttaagaacttttcatagataaggacttttctagaaatatgaatagactatttgcccagagcttcagttatcatgttgacaaggagattatattgggtcacttgccctcttattttctcccagggtcagaaatgaatagccagtcagcagctttaactccttcctgttcaaaaaagtgtgcataaatataaaattcattgaatttttaaaaactgaatatatgcttgtaaccagcacacagatcaagaaatatccctattccagctgcccagaagcctcccctcatgcttgtttcctgtgactacttccatccaggggcaagtaatcaccatgatataattttataattaaaaatgtgttatttgaaattgttgattggtacccctataagaattcatatctagataatcacatatacacatgtgtagatagtaatctcttaaattatagaatggggtctaacttctgtctgttatgtgaaaatatgaagctttctaagcatgtggctttcaaaagttttcttaggatttggcaaatgtaaataatgcatagatcctgtcgttctttgtttatattaattatttgagtacaacatgaatatatttgtgctgtaaaaagattcaagcaataaaaagtagtaaaatgtaaaagctttttcatcaccttataacacaatcttctcctgaccccagaagtcacccctactaatagatatttttctattagagttttgcttttgacatgaacaacatgttatagaccattatgtgtcagaataattagactcttcctattgattgtaatggctttattttattatagcacaaaggttaccataaagtctctgaagtcagactatctgactttaaatcttgaccttgctacttccctgctgatgaccttgtgccagttacttgctttttccccagtttcttcacctaaaaatgggaacagtgataatcatagtattttcccagaggattaagtgaattaatagggataaagtttataacagaccctggcagaggtcaagcattggatatattttgccattattaagatgttatcatattgcacatttgattattaatattgctataattcacttaaatttttgtctgttcatggccaatatgttgtttctaaacttttcctataacaaagttacaatgaatataatgctttcatggctttttactcatggatgtatttatttcaataaattatatttgtagaaatgaaaaggtcaagtggaacataatgcacattttgatttgactggcattcccaaattcactttcaataagtcttatcattgtatccctaacactgtatgaaaatatttgcttccctgcatctgttgtcagccaacatcagatatcattaatcttttaaatttttgccagtgggatggatgtgaggtttgattattagaaatatgttcgctgtgactgggagggcatgggaataactgcgtctaaacaaggtcttagaccaagtctgagcatgtgtgtccttggtcttataggcagaggtgtagtgggtactattgggttcagctgatccaaaatcagcttccaagtttacctcaaataactcccctgggttgtctcctatttctgtatattgtaattctgatcttggagccatctctaaagcctccattttcatgaaagttctttcttagatgagttttaacctagaatttcctgcagtcttgtttctctttattcaaccttaacagccttttgtgttctggtcctttaagagcactcttcttttgttttccaatgtatctatagattgtttattaatagtcttcactattttctttagaacttttaatttagacttcataaaaggtattgttgcattaaagtggttctcactttcgaacaagtcattaaaattgatcattctagtttgggacaatattaatatctcttggattgtatgggcaatgaaactgtagtattctaatacacacattagaattaaaattaaaaattagtcatttttacacattgatttatacatttattaaaataagaatgaaaggatgccagagtaggatatccctagcaatatgtttttccactgcatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaagggaaggaaggggataaagggtgaaaaactacctattgtgtactatgctcactacctgggtgatgggatcattcgtaccccgaacctcaccatcacacaatatacccatgcaacaaatctgcacacgtacccctgaacctaaaataaaagttgaagttaaaaaagaaaaaaatagtacttttgaaataaaaagcaagaagaaaaatacttcactgacactataaaattaagagggaaacctataaacagttcacttgaggtgtaaaagtataacagtcatttaattaatgggcttatttcttttatgggcattcgtttgattaaatcttttgttcaggcatatttataattttatattatactgtcactctggtcttctacattgcctcatttactgtacttcttttgtttgtgttgtatcttcttttcagtttagttgtagttgttagggtccacccaactggacagtttccccctcctatagacctaagccccaaaggccaaaagtaaaaccccctaccccaaacctgcctgtatctgtctgaccagaggccagctgttccaggatggggtcaagacgtctaccttacacaacagaactggcaagaaaaacatctccaggaagtggtcagacacctggcacaaaggaccccccacccttttctttttccttcaccctgacccagttctatgccctataaaaccttgctatagcctgtaagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagcaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaacaatttcggtacccagtccttgagataactttctgaaggaatgatgttaacattaatgaataaaaaaggaacaaataaaaagtacaccacacatactttgcttgtgttctggtagcactagccctaaacacaatatgagtaaggtaacaaaaaagtaacctgagatatattaaaaatggttttaaagccaaaagggaggaagaaaggaaaaaaggaaggaagggggaagggcgaaagtgaaaaacatatggaggaaggaaaggaaaataatatcaaatgttcacagagtgcttattctgaattatgtaccctcttatgtgctttatataaattatattgtaaggttgaaaatatgtgctctggagaagagctgcacggaataaaatcccacttctgctttttactgatggtgtgacatttagcggattagttaatttggtcattgcttcagtttcctatttgactgtcctaccataagactataataaaccaatgcatataaaaatgcttagcactgagtctgacatatggtaagcatacaataaattttaactacaattatccaatgaaaacctaacaacaacactatgaagtttgtataattattatttttacttttttgataaggagtctgaatcacaaagggattaaataatttactcaaagtcacgcaggtattaatcatgaatctatcttccagtaaatatcaatagaaaacaagatgtgggatttgagtgcaggcaattagactccagagcctgtttttaaactctatgttattacaagaagacatgcacgtacctttaaaagaagaaaatttgagacagcaaatgcttaacaaccaagaaattacaaaagaaaaaaacctacaatctatgaaacaaaaattatatgatgagattaattaatacatttaacaaatacttattgagcaccaattattggttcaaccatgcttttaggtactgagaattcaactgtgaactggtctctactttcacagaatatactttataatacagtataaaatggcataacaaaatggaaatggggttggtaaaggcagcaaaaatcttcaacagaaaaataaatatttttataaaccaataatttttgaaagataggatatagcatataagcatatggaaaataggtatccatgatagagaatataatagtggaacagttaatgacttctgacatgaaggaagtactgagatgagaattgaacaggatttgttttccttcagaaaaaaaataatcggtagaaaaaatatatgctggtatagctaaaaaaatttgaggattaaaaaatctcttctatacaatatataaaaatgcatagcacctgtaagaaaacaaatatattgggttggattcaaatttttttgtaccaaaatttccaatagataatggagcaagtctgcaaggatatgggcaaaaaatagtgggatctaaatatgttgtacatagattgttattcctgtcaaagggatgaggagttggtctcatatatgtactaacacagcagatacaataattcggaaacttcttgagaagctttgtagttatatatacactgtaattatttataatactattaaatgcaatataacaatttaatacatagagaagctgccttattgaaatattgaaataagcattgaaaaatctaaatgtagctggcaagatggcctaatagaaacagctctggtctgcagctcccagcgagatcaacacagaaggcaggtgatttctggatttccaactgaggtacccagttcatctcattgggactggttagacagtgggtgcagcccacggagggtgagctgaagcagggtggggcatcaccccaccagggaagtgcaaggggtttgggaaatccctctcctagccaagggaagccctgagagattgtgccttaaggaatggtgcattctggcccaaatactacacttttcccatggtctttgcaacctgcagaccaggagattccctcaggtgcctatgccactagggccctgggtttcaagcataaaactggggatcatttgggcagacacccagctagctgcagtttttctttttttcataccccagtggcaccaggagcccgagtgagacagaacccttcaatcccctggagagagggctgaaatcagggagccaagtggtctggctcagtggtcccacccccacggagcccagcaagctaagatccactggcttgaatttctcactgtcagcacagcagtctgaagtagacctgggaggctccagcttagtggggggagggacgtccaccattactgaggcttgagtaggcagttttcctctcccagtgtaaacaaagcctccaggaagttcaaactgggtggcaaagccacagtagccagactacctctctagattcctcctctctgggcagggcatctctgaaagaaaggcagcagcccaaacaggggcttatagataaaatctccctgggacagagcacctgggggaagagcggctgtgggtgcaacttcaacaaacttaaacattcctgcctgctggctctgaaaagagcagcagatctcccagcacagtgctccagctctgctaagggccagactgcctcctcaagtgggtccctgacccctgagtcccctgactgggagacacctcccagcaagggttgacagacacctcaaacaggagagctctggctggcatctggcaggggcccctctgggacaaagcttccagaggaaggaacaggcagtaatctttgctgttctgcagcctctgctggtgatacccaggcaaatagggtctggagtgaacctccagcaaactctagtagacctgcagcagaggggcctgactgttagaaggaaaactaacaaacagaaaggaatagcatcaacatcaacaaaaaggaagtccacaccaaaaccccatccataggtcaccaacatcaaagaccaaaggtagataaatacatgaaaatgaggagaaaccagcacaaaaattccaaaaaccagaatgccttttctcctccaaaggaccacaactccttgccagcaaaggaacaaaactggatggagaatgagtttgacaaattgacagaagtgggcttcagaaggtgggtaataacaaactcttccaagctaaaggagcatgttctaacccaatgcaaggaagctaagaaccttgaaaaaaggttagaggaattgctaactagaataaccagtttagagaagaacataaatgacctgacggagctgaaaaacacagcacgagaacttcatgaaacataaacaactatcaatagccaaatcgatcaagcggaagaaaggatatcagagattgatgatcaacttaatgaaataaagcgtgaagacaagactagagaaaaaagaatgaaaaggaacaaacaaagcctccaagaaatatggtacaatgtgaaaagaccaaacctttgtttgactggtgtacctgaaagtgacagggagaatagaaccaagtgggaaaacacttttcaggatattatccaggagaacttccccaacctagcaagaaaggctgacattcaaattcaggaaatacagagaacaccacaaagatactccctgagaagagaaacaccaagaaacataatcatcagattcactgaggttgaaatgaaggaaaaaatcttaagggcaaccagagagaaaggttgcattacccacaaagggaagccagtcagattaacagccaatctctctgcagaaaccctacaagcaagaagagagtaggggccaatattcaacattcttaaagaaaagaattttcaacccagaatttcatatctagccaaactaagcttcataagtgaaggagaaataaaatcctttacagagaagcaaatgctgagagattttgtcaccaccaggcctgccttacaagagctcctgaaggaagcactaaacatggaaaggaaaaaccggtaccagccactgcaaaaacataccaaattgtaaagaccatcaacgctatgaagaaactgtatcaactaacaggcaaaattaccagctagcatcataatgagaggataaaattcacacatatcaatattaaccttaaatgtaaatgggctaaatgccccaagtaaaagacacacactggcaaatcggataaagagtcaaaatccactggtgtgctgtattcaggagacccatctcacttgcaaagaaacaaataggctcaaaataaagggatggaggaatatttaccaggcaaatgaaaagcaaaaaaaaaagcaggggttgcaatcctagtgtctgataaaacagactttaaactgacaaagatcaaaaaagataaggaaaagcattacataatggtaaagggatcaatgcaaccagaagagctaactaacttaaatttatatgcacccatacaggagcacccagattcataaaacaagttcttagacacctacaaagagacttagactcccacgcaatagtagtgggagactttaacaccccactgtcaatattagacagactgatgagacagaagttaacaaaaatattcaggacttgaactcagctctggaccaagcagacctaacagacatctacagaactctccagcccaaataaagagactatacgttcttctcagcaccacgtcacacttattctaaaattgaccacataattggaagtaaaatactcctcagcaaatgcaaaagaacagaaatcataacaaacagtctctcagaccacagtgcagtcaaattagaactcaggattaagaaactcactcaaaactgcacaactacatagaaaccgaacattctgctcccaaatgactactggttaaaaattgaaattaaggcagaaataagtaagttctttgaaaccaatgagaacaaagacaccatgtaccagaatctctaggacacaattaatagatcttcctgctttctcctgtgtgcatttagtgcccataagagaaagcaggaaagatctaaaattgacaccctaacatcacaattaaaagaactagagaagcaagagcaaacaaattcaaaagctagcagaagacaagaaataactaagatcagagcagagctgaaggagatagagacatgaaaaacgcttgaaaatatcaatgaatccaggagctggtttttttgaaaagattaacaaaatatgtagaccactaggcacattaataaagaagaaaagagagaagaatcaaatagacacaataaaaaattataaaggggatatcatcactgattatcatcactgatcccacagaaatataaactaccatcagaatactataaacacctctgtgcaaataaactagaaaatctagaagaaatggatacattcctggacacatacaccctcccaagactaaaccaggaagaagttgaatccctgaacagaccaataacaagttctgaaactgaggcagtaattaatagcctaacaaccaaaaaaagcccagaaccagatggattcacagccgaattctaccagaggtacaaagaggagctggtaccgttacttctgaaactcttccaaacaatagaaaaagagggactcctccctaactcatggaatgaggccagcatcatcaggataccaaaacctggcagagacacaacaaaaaagaaaatttcaggccaatatctctgatgaacattgatgcaaaaatcctcgataaaatactggcaaaccaaatgaggcagcacatcaaaaagtttaccaccatgatcaagttgacttcatccttgggatgcaaggctggttcaaaatatgtaaatcaatcaacgtaatccatcacataaacagaaccaatcacaaaaaccacatgattatctcaatagatgcagaaaaggcctttgacaaaattcaacagcccttcatgctaaaaactctcaataaactagatattgatggaatgtatcttaaaataataagagctatttatgacaaatccacagcaaatatcatactgaataggcaaaaactggaagcattgcctttgaaaactggcacaagtcagggatgacctctctcaccactcctattcaacatagtgttggaagttctggccaaggcaatcaggcaacagaaagcaataaggtgtattcaattaggaaaggaggaagtcaaattgttcctgtttgcagatgatatgattgtatatttagaaaaccccatcgtctcagcccaaaatctccttaagctgataagcaacttcagcaaagtctcaggataccaaatcaatgtgcaaaaatcacaaacattcctatataccagtaatagaaaaatagagccaaatcatgagtgaactcccattcacaattgctacaaaaagaataaaatacctaggaatacaacttacaaggtatgtgaaggacctcttcaaggagaactacaaaccactgctcaaggaactaagagaggacacaagcaatgcccatggataggaagaatcaatatcatgaaaaatggccttcctgacaaaagtattttatagagtcaatgctatccccatcaagctacgactgactttcttcacagaattagaaaaactactgtaaatttcatatggaaccaaaaaagagcccatatagccaagacaattctaagcaaaaagaacaaagctggaggcatcaggctacctgacttcaaactgtactacaaggctactgtaactgtacagttacagtacggtttggtaccagtaaacagcatggtaccagtaccaaaacagatatatagaccgtggaacagaatagaggcctcagaaataatgccacatatctacaaccatctgatctttgacaaacctgacaaaaacaagaaatggggaaaggattccctacttaataaatggtgctgggaaaactggctagccatatgtagaaggctgaaactggaccccttccttacaccttacacaaaaattaaccaagacggattaaagactaaatgtaagacctaaaaccataaaaaccctagaagaaaacctaggcaataccattcaggacataggcatgggcaaggacttcatgactaaaacaccaaaaacaatggcaataaaagccaaaattgacaaatgagatccaatgaaactaaagagcttctgtgcagcaaaagaaactatcatcagagtgaacaggcaacctacaaaatgggagaaaatttttgcaatctatccatctatccatctgacaaagggctaatatccagaatctacaaggaatttaaacaaatttaccagaaaaaacaaccccatcaaaaagtgggtgaaggatacgaacagacacttctcaaaagaggacatttatgaggctaacaaacatatggaaaaaaagctcatcatcactggtcattagagaaatgcaaatcaaaactacaatgagataccatctcacgccagttagaattgcaatcattaaaaagtcaggaaacaacagatgctggagaacatgtggagaaaagggaatgcttttacactgttgtggaagtttaaattagttcaaccattgtggaaaagaaaacctccaacctctcaactatgtatatagaaagtccaaggaaaagatctcaggtaatactacaaaaattgggaagtataggtggtctattgatttcctattagtgcggtaccaagttgtcacacttagtgtctaaaatagcacacatttgttatcttgtagttctgaaggccagaagtctggaatggtttccactaggctaaaatcaagatattggcaaggctgcgttttttttcttaaggctctacagaagaatctgacttcttgcttttcttttccagctactacacgttgtctgcattccttggctcatggtccttttaatctttaaagccagcaaaggcccatcaagttggtctcacctggaagagctctaatactgatgcttctttgtctcttccacttttaaggactctcacgattacattaagcccacctatataaccaggatatcctattttaatataagctaactagcaaccttaattcccctctgtcatgtaacctaacctattcagaagttctggagatttggacagagacacttgggaagccattatgctgctgaccataggtggtaggaagtttaaattttatagctaaggacaataagcattcattcatttctgaggtagattaatattgaaatattttacatttatggaatttttctaatttagaaattttctaatatttcctcaggataagattatgcatttttgacaaaaatattgctaaactgatgttgaattctcatgcattacatcaaggagcatatgatatacttgcatctcattatccaaaacgttatcttggatcatttaactacggtagaatctgcccagttttttcactgaaaagttacaattttaactttgaaattaataaagtatcttgtgggtagataatttcagactatgtaactatcctgtttcaaatttttgtccactgctttaagcagtcatttataattctttgctggaacacaccaacagtgtggggaggtcaattttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcatcctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcggtggctcacgcctgtaatcccagcactttgggaggctgaggcaggcagatcacgaggtcaggagatccagaccatcctggttaacacagtgaaaccccgtctctactaaaaatacaaaaaaaattcgctgggcgtggtggcgggtgcctgtagtcccagctactcgggagggtgaggcgggagaatggcgtgaacccgggaggtggagcttgcagtgagccgagatcgcgccactgcactccagcctgggtgacagagctagactccatctcaaaaaaaaaaaaaaaaaaaaaaaaaaaagtcatacagattctaaataatttcttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaataatttcttgatacattgtgtaagaacagaattatgctaagtgaaaccaagacaagtaacctagccctatattaagagactcacaatatggtggctgtgtctgcatacagaaatataaaaaaataatattcaggccacgcacggtggctcatgcctgtaatcctagcattttgggaggctaaggtgggtggatcactcgaactcaggagttcaagaccagactgggcaacgtggcaaaactccatctctactagaaatacaaaaattagctggtcatgatggcgtgcacctgtggtctcagctacttggggggtgaggcaggaggatcacttgaacctgagagatcaaggctatagtgagctgagatggtgccactgcactcccatccaggtgacagagtgaaacccctgcaaaacaaattaataatattaaattaattgagtcagagcagaatatggcaaatacaagaagttatttctttaggagtttcaaaaatgtagacctcgtatcttcttcagattatcaggaaagctagaggcatgtgagttagctttaaattaataagtgagtcttgacagaatatgatacctggaggtagagggaaggagagttttggaaggcaagggaaatggatagagtgcatgccaaaagaagtgaaatatagagtgtattagaaataaaatataataataaccattacttatggcacaaattggaattttcaaatgctcttggttaaaatcctaataatttcagtgccttatttataattcagttttatgtaaaacttatagattattatagaaagaccacaaaaattccatggcattttacaagtgttcctcttaaactcaggcacagaatttatgctttactggttcctaattatgtttttcttttctgtctcttctttattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggtatgttggcttttgtgcagtttgaagataatatgaaatatttgtcccatatttcagcagccattggcagggctgttcattcattcatttatttacatatatttatggaattccaggaactgatccaggcacctgccctcattggatctgcattctgaaggactagatggacaataaataattatattagagaatgagaaggattctgaaggaaagtaaaagtgatataatagaaacagaaagtggaggctgctatttttatagagtattcactggaggtcatgagaaaataagatttattatgtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcctgcaccgcccttaatccattcaactctgagttgacacagcacatgtttcagagagcacggggttgggggtaaggtcatagattaacagaatctcaaggcagaagaatttttcttagtacctaacaaaatggagtctcctatgtctacttctttctacacagacacagtaacaatctgatctctcttgcttttccccacaattatgtcttacctgaaacctttgtattttcttaataaagttcagggcacatgtaagatgatagaaatatcactatgaactgtaaggtccaaagaactgacacatctgatatgattatgtcttcagtctgacataagtagaaatttaggccctcatgtggttagctagagagatttccaacagtttttgagagaagatgcaacaatattaatgatttttcaaaaagtggtagtttatgtgtgcaacataagtttacattgtaaagcttagggtagcaccctaaagtacttctgggcccacagaagtactttaccttactgcatagatctgagtttttgtgatgtttatcattaaaaaaaaattttattgaggttgtgatgaaaggacccttcccttgacccctgcttgggactggtgaaggggcggctcccttactccacctgcaactctcaagccccttgtgggagggggagcatgcaggtgagagggtgcaggagctagggcaagtgcttttgggtgccagcagtaactaatcctgtaccagccccagggctgtgtctagaggttgcctgtgacccctggagccccagaaagcagacagctaagtgttaaccagctcagtggagggtcagggtgacagcattttgcacctgtcctcttggtacctgagttcctgtctggcattcaggaagaatcaggtcgcatgaacgaattgaagtgtggtgaatgtggaggattttattgagcggtggaagtggctctcagcaggatagagagctggaacggggatggagtgggaagatgattgatggtccctggttgaactcctctccaaccatagtctccaatgcccagctgttttttttctcgatgttcagatgcttcttgtcttctctccttctctgccgcaccactctgctgctgtgccattggaacctggggtttttataggtataggatgcggggcgtggcagggcaggatggttttgaaaaaggcaaatttcaggtgggaaaacaggattgcatgttctcacttagagcccaaggtccaagcttgaaggtggagtccttgccagggactgcgcccttttctaactagtatttccttgcctcctgtccatatcagttacattatcaagatactgtgctaaacaaaaagagggtgtacaccgcatattctcactcataggtgggaattgaacaatgagatcacatggacacaggaaggggaatatcacactctggggactgttgtggggtggggggaggggggagggatagcactaggagatatacctaatgctagatgacgagttagtgggtgcagcgcaccagcatggcacatgtatacatatgtaactaacctgcacaatgtgcacatgtaccctaaaacttaaagtgtaataaaaaaaaattgctaggagttataacatttaacattataacattatataacattataacatgtaattcagactactggaaatagatttacatgggtgatttgtaagaacagtaaaatgtgattttactaaaagattataaaaaagcatggaaatgtaaatttttgcctagggttgaaggattgttttgaattagataagataaagctgaaggtttaaacaaatgatggaaggattctaaaaactaatcttgcaaaaactgtatgtgtgaacatatttactaaattcaaaggggtattataggatttttctgtaaattgagcattgaaataaaagtacaataaatgttaaaaaaaaaagagggtgtacaaattgataattattgttatcactcccagacaagtttttttttaatttaacttctatttttaattcaggggtacatgtacaagtttattacacaggtaaacttgtgtcatgggggtttgttgtacagattattttgtcacccaggtattaagcctagtacccattggttttttttttttcctgagtctcttcgtccttactccctctaccctctgataggccccagtacgtgtcgttcccctctatctcatcattagctcccacatataaatagtaacatgtagtattgggtttcctgttcctgcattagtttgctgcagataatggcctccagctccatccatgttccgtcaaaggacatgagctcattctttcttatggctacatagtattccatggtgtatatctaccacattttctttattcatctaccattgatgggtatttagattgattccatgtctttgctatcgtgaatagtgctgcagtgaacatacacatacatgtgtctttataatagaacaatttatattcctctgggtatatacctagtattgggattgctgggttgaatggtagttctgtctttaggtctttgaggcattgccacattgtcctccagaatggttgaactcatttacatttgcaccaacagtgtgaaagtgtttatttttctccacaattttgccaacatctgttactttttgactttttaatagtagccactctgactggtgtgggatgatatcccattgtggtttttatttacatttctctaatattcagtgatgttgagctttttttcatatgtttgttggccacatgtatgtcttcttttgaaaaatatctgttcatgtcctttgcccactttttaatggggttgtttattttttgtaaatttgtttaagttccttttagatgctggatattagaccttagtcaaatgcaaagtttgcaaaaattttctctcagtatgtaggttgtctctttactctgttgatattttcttttgtcatgtggaagctctttagtttaattattaatagattccatttgtaaatttttgcctttgttgtgattgcttttggtgtcttcctagtgaaatttttgcctgttcctatgtccagaatggtattgcctagttgtcttccagagttttcatagttttgggttttacctttaagtccttaatccatcttgagttaaattttgtacatggtataaggaaggggtgtggtttcaatcttctgcacatggctagccagttatcccagcatgatttattaaatagggagtcctttccccattacttgcccattgtttttgttagctttgttgaaggttagatatttgtaggtgcatggatttgtttctgggttctctattctgttccattggtctatgtgtctatttttgtactagtaccatgctattttcattaccatagccttgtggtatagtttgaagttgggtagcataatgcctccagctttgttctttttacttaggattgctttagctattcaggctcttttttgcttccatatgaattttaaaataatttttctagttctgtaaagaatgtcattggtgatttaatagggatagcatggaatctataaattgctttgggcagtatggccattttcatgatattgattcttcctatccgtgggcatggagtgtttttctatttgtttgtgtcatcatggatttctttgaacagtgttttgtagttctccttgtagaaatctttcacctccgtagttagctgtattcctagatattttattctgtttgtggaaattttgaatgagattgagttcctgatttggctctcggcttgactgttgtggatgtataggaatgccagtgatttttgtacattgatttttttttaccctgagacttttaggaaagttattttgccaataaaaagtgctctcaatattttgtcccatacatattttaaattacattaattagtttaaagttcttgcatacaaattacccatccttggccaggcagagtggctcacacctgtaatcccagcattttgggaggccaaggcagacagatcacttgaggccaggaattcaagaccagcctggccaacatggtgaaaccccatctctatgaaaaatacaaaaattagcctggtatggtggcgtgcacctgtaattccagccactcaggaagctgaagcatgataatcacttgaaccctggaggtgaggttgcagtgagccgagatcgtgccactgcactccagcctgggtgacagagagagagactgtctccaaaaataaaaaataaaaattacccatctttagctctttgtttgccttctcaggaggcagccaccttcagcaatttttgctttttttttgtaattactactatatttctaaataacatgttttcaatatttttccttcaaactctcatagatgtaaattgagttgtcatcaactttcaccacatcagcacaaacatacattcatacacttcaccttctcacattctcctggtataattatatcacaatttttgtttgaatcaacatacagaatatacattcttattttacatatatcttatccgtgctgagccttggaaagtgctgtatcaatttctctcttataaaatgtttttcattttcctagatttattaagggtatattttgatttgcttagtttgggtgtgtactcattagtaatgtatcctcaaattctcttccagaggtgttactctcttgtcaatacctttaaacatatcaggtatctataaatatacgtgcaggtacgtttcccggtgttttctgttctctttataggaacacgttactcccagggcagagcagctcctgctctgggataccccttcactgataccctaacaactctcttcacctctctttgtgtacaaccccattttctggatgccatgtccccttctttttttggtttattcctttctgagaaatggtttattgagatgaaacgtttgagctcttatttgtctgcaagtatctttattctgccctcacacttaattagttagctgtatgaagaagtctaggttggaaatttcttctgtcagaatttcaaaggaattactctattgctactgctataaaatatggtattactgctgaaaaaacatgatatttaattctttcttcttttgcccatgatttgtattttgtttttcttatggaaatcttttagaacttccctttatccctaatgttctcaattccatgaaactatgctttgaagtaagcctttttattttgtatttattgtgctggatataaattcgggctttgcaatctgaaaatgagtggcctttaatcttagggaattttcttgtggagttcttttctgtttttctttcttctactcatattaatcagatattagagattctggattgctcttttaatttttttcatctttttactttaattttttgcccctcattcttctattttcaaggattgtctcaactttctcttttaaactttatgttgaactcctcaatactgttaccgttatcttaaatattttgagttatttttattttctgcatatttctgtagttcccaccatgatacaacagtatcatgatacaagcagtatcatgtacatgtttcacggacaaagtgcattatatctctggtgttattagtaatagttttttctgttttctatttttcatatgtctgactcaatttggttttcctataagtatttttcttcctatgtgtgttagtctttttcttttatgtttgaggtttccctagtgttaactgcttatttttcattgcatttaaaaattgttttaatttgttttttttttagttaatatgggtacatatgtgtatatttatggggtacatatgatgttttgatataggcatataatgtgtaataatcatattagggtaataatcatattagggcatttgggatatccatcacctcaagcatttatcatttctttatgttaagaacatttcaattctactcttagttattgctaaatatacaataaattattcttgactgtagtcactctgttgtgctatcatatactagctctaaggctaggtgcagtggctcatgcctgtaatttcaacacttggggaggccaagatgagaggattacttgagcctaggagttcaaaaccagcctaggcaacataatgagaccccatctctactaaaaattttttttaaaataactggtgtggtggactgcacctgtattcccagctactcaggagcttgaggtaggaggatggcttgagcctggggacacagtggtggtaggagcagaggggttaaggctacagtgaaccatgatcacgccactgcactccaccctgtctcaaaacaaagaaacaaacaaaccaaaacaaaacaaaacaccaccagaaaaaaaaagactagatctagttaactgcttcttagcttctgtgtttcagagtgaggcatagcgtggctgcctggaagttctgcatgcctggaggataaggttaggactactgtccacttcattagtctggactattcattgggaaattcccaactgtaaaaatctgcatatcagtgttattgaacaggtcactttttccagaaggagattttctaacatactgccgtaggaatgtagggctggctgttacattccacattgccatgcagtgcagcggtatactttcgcttaatccttctgcatcacagtggcactcattacccccgcacctggtgactcggggtttagagtacttatggttctgcctcctcagagagtaaacctccattcttctatcaacatgaggaaaaagccagtggcatctaattggatttatatataatttccaccaatcatgttgttttctcaatctcacatttagtagtatctggcactttaatttctaaggatttatgctcttttatcctacacctatcatttcagtggaattgtgtgagggagataaggtaaaatatatgcttaatattccattttcaaccaacggctagacacagttttttgcatttttgttgacaaataatactatcataagctaacacattttagaactgaaaaagacattctcttttagtttccactcactagagtcactcaagcatttattataatatgatctggataggtgacttttaaaagatatacttgaattatttaggttatttaaaaatactttatgtgtaagaatattttgtttcagaaaataaattgcagaaaaattaaaaaaataaatttcaaaactctgagaaatgcataatattcatcttttgagaaatgagaatatttgctaggagaagaatattgttccttttctgtaatagcagatgggtgtttagaatagcaaactactacaataattttattattttcttttataaactttacagtagctaaggtttagtaggaaagtaatacttttgttcatgcaaagtgctctttattctggatgtgtctctggggttaattgtctcatttcagtctatattaataaaaacattttattctgtatgtaactcctgattcctcataattttggggtgcctttccaaactagaaaaccgacgttctgactgtttattcatttaaagggcattattgcatcagagtcaatggtttagactctggagtcttacttcccaggttcaaattcttaaaatgctcctaactagccgtggcaaagtatgtaatatttgtttatttgttacctcgtctatattgtgaggaaaataacaaagccttcaaaagcctgttgtgaggattagatatgttaatagacagagaccacttatagtgcctggaatgtgataactactatgtaagttttgacattattgttagtgtactgaaaagcagagctctggagatattaggggaaatactgagaaacattgatttttctctgcctatcatgtagaaaacagttacattagtctcgtttccacaactttctattttcattttcagtgagattttgaaaatatgatcttttgaaagactgtttcattttcctttcaggatggccatttggaaacacgatgtgcaagatcagtggattggtccagggaatatctgtcgcagcttcagtctttacgttagttgcaattgctgtagataggtaagtctgcaccaaactctgaatccagaaaaattggcatgtctgcaactagtataccagaaaaatatataacctactaaatttggacatatcttttcaaattgtattcacaatatctacctctttttttaaattattatactttaagttctagggtacatgtgcacaacgtgcaggtttcttccatatgtatacatgtgccatgttggtgtgctgcacccatcaactcgtcatttacattaggtatttctcctaatgttatccctgcccctgcccccccacccaatgcaggccccagtgtgtgatgttccctgccgtgtgtccaagtgttctcattgttctattcccacctatgagtgagaacatgtggtgtttggttttctgtccttgtgatagttagctgagaatgatggtttccagctgcatccatgtccctgtaaaggacatgaactcatcctttttatggctgcatagtattccatggtgtatatgtgccacaattttcttaatccagtatatcattgaaggatattttggttggttccaagtctttgctattgtgaatagtgccacaataaacatacgtgtgcatgtgtctttatagtagcatgctttataatcctttgggtatatacctagtaatgggattgctgggtcaaatggtatttctaattctaggtccttgaggaatcgtcacactgtcttccccagtgactgaactagtttacactcctaccaacagtgtaaaagtgttccaatttctgcacaccctctccagcatctgttgtttcctgactttttaatgatgacctttctaactggtgtgagatggtatctcattgtggttgtgatttgcatttctctgatgaccagtgatgatgagcattttttcatatatctgttggctgcacaaatgtcttcttttgagaggtgtctgttcatatactttgcccactttttgatggggttgtttttttcttgtaaatttgtttaagttctttgtagattctggatattagccctttgtcagaagggtagattgcaaaaattttctcccattctgtaggttgtctgttcactctgatggtagtttcttttgctgtgcagaaattctttagcttaattagatcccatttgtctattttggcttttgttgccattgcttttgttgttttagtcatgaagtccttgcccattcctatgtcctgaatggtattgcttaggttttcttctaggttttttatggtttcaggtctaacatttaagtctttaatccatcttgaattaatttttgtgtgaggtataaggaaaggatccagtttcagctttccacatatggctagacagttttcccagcaccgtttattaaatggggaatcctttcccattgcttgttttcgtcaggtttgtcaaaaatcagatggatgtagatgtgtggtgttatttctgaggcctctgttctgttccattggtctatctctctgttttgataccactaccatgctgttttggttactgtagccttgtagtatagtttgaagttgggtagcatgatgcctacagcttggttcttttggcttaggattatcttggcaatgcgggctcttttttagttccatatgaactttaaagtagatttttccaattctgtgaagaaagtcaatggtagcttgatggagatggcattgaatctataaattaccttgggcagtatggtcattttcacgatattgattctttctatccatgagcatgaatgttcttccgtttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagattatggggttttctaaatatacaatgacgtcatctgcaaagaggaacaatttgacttcctcctttcctaattgaatacactttattgctttctgttgcctgattgccttggccagaacttccaacactatgttgaataggagtggtgagagaggtcgaccctgacttgtgccagttttcaaagggaatgctttcagtttttgcccattcagtataatgttggctgtgggtttgtcaaaaaatagctcttattattttgagatacattccatcaatacctagattattgagagtttttagcatgaagggctgttgaattttgtcaaaggccttttctgcatttattgagataatcatgtggtgtttgtcattggttctgttcatgtgatggcttacatttattgatttgcatatgttgaaccagccttgcatcacagggatgaagcagacttgatcatggtggataagttttttgatgtgctgctggattctatttgccagtatttcattgaggatttccggatcgatgttcatcagggatattggtctaaaattctcttttttttggggggtgtctctaccaggctttggtatcaggatgatgctggcctcataaaatgagttaaagaggattccctctttttctattgattggaatagtttcagaaggtatagtaccagctcctctttgtacctctggtagaattcagctgtgaattcgtctcgtcctggactttttttggttggtaagctattaattattgcctcaatttcagagcctgttattggtctgttcagagattcaacttcttggtttagtcttggaagggtgtacgtgtccaggaatttatccatttcttttagattttctagtttatttgcatagaggtgtttatagtattctctgatagtagtttgtatttctgtgggatcagtggtgatatcccctttatcatttttattgcgtctatttgattcttctctcttttctcctttattagtgttgctagtagtctatcaattttgttgatctttaaaaaaaaaccagctcctggattcattaatttttttaagggttttttgtgtctctatctccttcagttctgctctgatcttagttagttcttgccttctgttagcttttgaatttgtttgctcttgctcctctagttcttttaattgtgatgttagggtgtggattttagatctttcctgctttctcttgtaggcatttagtgctataaatttccctctacacactgctttaaatgtgtcccagagattctggtatgttgtgtctttgtcctcattgatttcaaagaacatctttatttctgccttcatttcattatttacccagtagtcattcaggagcaggttgttcagcttccatatagttgtgctgttttgagtgggtttcttaatcctgagttctaatttgattgcactgtggtctgagtgacagtttgttgtgatttctgttcttttacatttgctgaggagtgctttacttccaactatgtggtcagttttggagtaagtgtgatgtggtgctgagaagaatgtatatgctgttgatttggggtggagagttcggtaggcatctattaggtccacttgttgcgagctgagttcaagtcctggatatcattgttaacattctgtctcattgatctgtctaatattgacagtggggtgttaaagtctcccattattattgtgtgggagtctaagtctatttgtaggtctctaaggacttgctttatgaatctgggtgctcctgtattgggtgcatatatatttaggatcgttatttcttattgttgaattgatccctttaccattatgcaatggccttctttgtctcttttgatctttgtcagtttaacgtctgttttatcagagactagggttgcaacccctgcctttttttgctttccatttacttggtagatcttcctccatccctttcttttgattctatatgtgtctctgcatgtgagatgggtctcctgaatacggcacagtgatgggtcttgactctatccaatttgccagtctgtgtcttttaattggggcatttatcgcatttacatttaaggttaatagcgttatatttgaatttgatcctgtcattggcgagagtgtcccgattttccaggtacagtctgtcatggcttcccttggctaggaaagggaaattccccaaccccttttgcttcccagctaaggtgatgccccgtcctgctttggctcaccctccgtgggctgcacccactgtccaaccagtcccagtgagatgaaccaggtacctcaggtggaaatgcagaaataacccatcttctgcatctatcatgctgggagctgcagaccacagctgttcctatccggccattttggaacggaacctgagaatatctacctctttaaaagcaacatacctactaaagtttcagtaataagaaaatgaaactattgaattttccatactttaaaaataaataattggagatggtaaaatttccctatttttcacactacaatatagacgtttctaacagcagaaatgcaaatgagctaaaatctgaaattttatctagattttaagattgaaaatcattcatccattcattcattcacacatgttgttgagcatttatgatgtgccagatactgggctgggttggtaacatctaaaacaaattagaagtgctgcctcaggaaggctacaatctggcggagcaggcaaagtcattaacaaatatttacaaataatgctttctaataggtgaccagtgtttgacagctatgcaaaagagataataatcaattctacctattaggacagggagtagtggattcacaaaagaagtgagaccttctgattcctggagaagtcagaaatttacccttagaagaaactgggaaaagggcatcccttaagacaagtatatacttatggcattgaaataggaggcacttgttcagagaaatgtagagaggtagttcagctggaacaaggcaggtgaagtggtacatttgtccacaaagagagagatttattacgagaaattgactcataattatgaaaactgagaaatctcagaatatgctgcctgtaaattggagacctcagaaagccagtgatattattcagtccaagtcccaaagcctgagaactagggatagccaattgtgcaattggccatttgtgtaaattgcatcctgtgggcaggagaatatgatatgagatgtcctagctcaagcaatgagtcagggaaaaaagggggcaaattcctccttcctctacttcttgttctattcaggccctcagatgactggatgatgcctacccacactgggagggcaatccactttaccgaatccactgactaagatgctaatcttatccagaaacacttttataggcgcatccagaaataagattcaatctcagcaccccttggcccagtcaagtcgatagattaaattagccatcacacttttgtagcagagactgtcagtgctctgccagatctcttaaactttcagtgggttctgtcttacatccaactgccagtatcttcatctctgtatctcaaatccaaattgtgcaaagtcttagttcctaagcagaacagacaagaaatgtcagataattaatacccctagaagtagccctcaactaaaatctcatgagagttgatgtactcaccattctctccccttgggttgaataattctgcaacaaatggtttgattcacatccctcgttacctaccttcccattaatgaatgacttctctatactttcagttatctattgatatataatgaaccacccccaaatcaaaccacttagtgagttaaaatgacagcaatatttattatgtcatgaatctgtgatatgtacagatttagaaagtacagcttgtctctgttctacttgatgtcaggtggagcagcttcaaggttagggctgaaccttctttcactctcctgttggtacctagtccagggagaacttgaatatgtgggggcctaagagagctttgtctctattggtctctccaaatgggctctccagcaaggctacttgaaggtacctggacttcttatatgtcagttcagggctctgacggtttgtgtcccagaagagagtaccagcaaaaatcatgatgtggtatcatttttgttgcattctattcatgagactgagtcatcaatccttagccaaggaaaaaggaatagaatttggaagcaatgtcaaagaacttggaaatgttttaaaactgccacatctttatttcttgcacttgcactcaaatgctttttttttcagggctagcttttgcaggaagccaaactaaaaaaattcccaagctgatttctcctgactgaatcctttgcctgaattttacagttacgttccaaagcacctactgtacaacttcaactgcacattcaacaaaaggcaccttaaattaaacatgcccagagctgaactcattattccaagccccacaccatacacaaacaaaataaaaggcagctgtttttttcatgctccccaaatcagtgaaaggcaggaccactcactcaattcaaacaaaaaacctgagctttatccttgaatcttctttctgtcaactttgctggcactctccaaattctattatttctgagtgctaactagttctgaaccaggccactgccctttgccacttggaatactgagattgttttctaactggccttcgggctcaggaagccaacctccaatttattttcttctcatagcagcccaaataagcttcttaaattgtaaaaatgatcctgccttttacaatgtaaatccttcaatgaatccccattgctctttaaatgaagtccaaactttttagcagaattttagtaattattatacagtttttaatatttttatatttccattgactttctcagcagggactattctctatcttattcatctttgccttcctgaatatatacacacaaacacatatatatgtatgtttacaaatatataagtatatatactcatatatgtacatttattaaacaaatatgtaagtacatatattgttataaatataaatatataaatacatatatttgttataaatacaaatatataaatacatatatgtacagataagcatatgtacttttatatttgttcattattacttttattgttaatagtgtctgctatactccatttattcaaattttgagttaaaatttatctcctatataaatatatgtacttatatatttgtttaataagtaaattgaacaataatatccaaaaccctattagtaggtattcaaaaagagcaaaatacatacgtttgtgtctatgaaattacccataatttcacggcaggtgaatgggagaattcttggattagaagactggaagaacgcttgaagttgaagagagaagatcttacacatgaaggagttataaagaatgacaacagagcagtcaaagcccaggctaactagtcattctatgaagataagttagataagttaatttggagttgctgctcagccacttaaagctctacattttcttatctacagatctggaatgtaacaattttcataacatttcagttttatggagtcataaaaatcaaagaagattaaataggtaatagttactttgaaaaaatataaaatgttacacagttgcataatagtgtgattatcttttgattaacataatgaaattcaataataataacaagatccacaatatcaaaatcatagtaaaatgaatcaggcttactctacatactgatgctgaatttttgtactcaccagaggacatagaatgttaggaaggctcataatcagaactcataatgaatactctcagatttttacagctgtaaagcaaatcagcaaaacatttagtggcttcaaacaatattggtttattacatctcatgattttgtgggttaattgggcacctctttgttcatcctcctgctccatgtgttataactggaatcactcatgttgcagcattaatctgggagctaaactggggctggaacatccaaaatggctaagctcttatctcccggaatctttctctacatgcctttcatctaattcaagcttcttggaaattgaagtctggattttaagaggaagcattccagaaggacctgccccacatgcaagtgtataaaaagcttctgcttgcatcatgtttgctaatatcctattggtcaaagcaagttacacagataatgcgtaggggaccacacaagagcctgagggataaaaggttgattgattgctacagatcagcagtctaccacagcctaagagctacccatctaaagaggacgatgtagaggttgagtttgagctctgaagccaaactacttgtgttaaaatcctgtgtaattattggtaagatttttacatttccaagtctgttttgctatcttttaagcaaggaggcttaaagagacggtccatgcaaattaatggaacagagtctgaaacggttttaggcattcatgttcattattactttttattattaatagtgtctgctatactccatttgttcaaattttgaattaaaatttatctcatatcaattacagaaaatgacaatgcatgcctttctactacaaatggtaactttctatatttttgaggagactgtagggtgagaggcctgtaactacataaataaatttggtgtatgacttggtcagaagtgatgaagcagtgcctcatttatatttgtgtttaattgcaggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaagcctcatctttccaaacttaaccatttgtgtatgcgtcaaatcaagcctgcacgcgtgcgtgcatgtgtgtgtgtattttccccaaatggtgatgatgagcagtgctttgcatgaaactagattttatcaattt

SEQ ID NO: 390 - DNA, 109070 bp, Homo sapiens
cactgcaagctccacctcctgggttcacgctattctcctgcctcagcctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtaaccaatcttaattgggttctattatgttagatttttctctactcttatacccattcacatatatacactctcaaatcaatctttttgtcatcatttaaaaaatatatgcatcttgttttctaactcatgatgaccttgtggaaagccctccatgttgattgttatggataaaattcaattctaaatggctgtatataatataccgtgatatggataataagaaacaaattcaaccattcccttcttgataaacattcactttgtttccagaggtttctatcttgttgggttttgtcacaaaacaaggctacaataaaagtagttatttaaaaactactttatctccaggtttaaagagcaaagctatttttcaattttaatgtatgttgccttattgctttctaagtactacaaataattacatttttaccagaagactatgacactgttctttactcatgtccttacagcaataggtgttgtaactgtttatgttattagttgttaaattaatttgaatttcttaactacttgtgaaattaaatatatttttatcttcttcagatgtttggacttcttgtgtaaatcatttattaatattcttgctcattttactgagatattagtctttttctcaatttatacattctttgaatattgtaattattaatgcttatcatagtaggtgttttccatattgtcggctgcctttgttcataactttatcatgcacatttaaaatatttgtatagacaatatatttattattgtatacattttggattccagtgttgattaatatgattttttcttattgctgcattagacatgtagtcttctagattttactgaaggatttttatttttaaaaattttagcatgggtttttaattcaagtggagttttaaaacacatgccataaatagtgagccaactttcacttcttccaaacagcttactaaatattttattcttccccttcgaattgaaaacacacttttgtcatattttaaaatctcatatataatgggatctatatttgtatccttgattctgtttcactgaccaatttgtccatttctatggcaacaccaaattgctttgattatatttgccatagattatttttctgatatcctaaaaagcatatctccttactgtttttcttcacaaatgttcttagcttttcttgggcacattttcttccctctgaacttttaaaaatcatattccaaaacaaatcctgtcactgctttgcaaatatttttaccaaacgaactgtttgtctatacatattttaaatgatattatattaaattgatatgttaatttggggagatgacctataaagtattaaaatttatcttccaaaaatcaggcatgttgttcaattttaaagaaattttaaaatctttcagtagggttttattttttatgtcatcattttatattccatcttttgcctgttaaatttatttttatatatgctacattttagtcactgctgtaaaatatatatatatatattcattttaatttctaggtgctattgctaatattaagaatggctacttttaaaaaatttttaacttattttatattcagggggtacatgtgctggtttgttacaaaggtatattgtgtgatgctgaggtttgggtacagttgaacccattacccaggtagtgagcgaactacccaatacgtaatttttcaacccttaatcccttcctcccttccccttcttgtattccttagtgtctattgtgcccatctttatatctatgcgtttccaatgattagctccctcttataagtgagaacatatggtatttagttttctgtttctgcatttatttgcttaggataatggcctccagccgtatccatgttgctgcaaagtacatgatgctgttcttttttataactgcatagtattacatggtgtatatgtatcatattttttaaatccaaaccactgttgatgaacgcctgggttgatttcatgtctttattattgtgaatagtgctgcaatgaatatatgaatgcaagtgtcttcttggtagaatgatttattttcctttggatatataccaagtaatgggattgctggtttgaatggtagttctatttttagttctttaagagatctgcaaactgttttccacagtggctgaactaatttactctcccaccaacagtatataagcattcctttttctccacaacctcgtcagcatctgttctttttagactttttagtaatagccattctaattggtgtgagatgatatctcactgtggtttgatttgcatttctctgatgtttagtggtgttgagcatttttccatgtttgttgactgctcgtatgtcttctcttgacaagcatctactcatgtcctatgttcactttttaatggagtttattttttcttgatttaagctccttatagattgtggatattagacctttgttggatgcatagtttgcaaatattttctcccactctgtaggttgtctgtttacttcgttgagagtttcctttgctgtgcagaagctctttagtttaactagagtctcacttgtcaatttttgtttttgttgcaattgcttttgaggtttataaattctttgccatggccaataatatggcttggctgtgtcccccacccaaatctcattttgaattatagttctcataatccccatgtgtccctgctgttcttgtgatagtgagttctcatgagatctgatggctttataaggggcttttcccccttttgcttggcacttcttgctgccaccatgtgaagaaggaaatgtttgcttccctttctgccataattgtaagttttctgaggcctccccagccctgcagaactgtgagtcaattaaacctgtttcctttataaattacccagtcttggctatattcgtatagcggcgtgagaatggactagtagagtatattaatatccagaatggggtgctgctataaggatagccaaaaatgtggaagcaactttggaactaagtaattggcagaggttggaacagtttggagggctcagtagaagataagaaatgtgggaaagtttggaacttcctagagacttgttgaatggctttgaccaaaatgctgatagtgatatggacaataatgtccaggctgaggtaatctgagattgagatgaggaacttgttgggaactggagcaaaggtaactcttgtatgctttagcaaagagtctggaggcattttgcccctttcctagagatctgtggaacactcaacttgagagagatgatttagggcatctggcagaagaaatttctatgtggcaaagcattcaagagaaagcagagcataaaagtttaaaaaatgtgcaggctgattatgaagtggaaaagaaaaatccattttctgaaaagaaatttaagccagcagcagaaattttcataagtaacgaggagcagaatttaatcaccaaaacaatgagaaaaatgtctccagggcacatcagagaccttcatggcagccctcccatcacaggcccagaggcctaggagggaaaaatggtttcttaggccaagtccaggcccccttgctgtgttcagccttgggacttggtgccctgtgtcccagccactccaaccgtgggtaaaaggggtcaatgtacatttcgggccattgcaattcccaatccttggtagctgccatgtagtgttggtcctgcaggtgcacagaagacaagaattgaggattgggaacctccacctagatttcaaagaatgtatggaagtgcctggatgtccaggcagaggtatgctgcaggggctgatcgcttgtggagaacctgctagggtagtgcagaagggaaatgtggggttggagccctgagagagtcctcactggggcactgcctagtaggcctgtgagaagaggctactgtcttctagacctcaaaatggtaaatccactgacagcttgcaccatgcacctggaaaaggtgcagacactcaaagtcatcccatgaaggcagtcagtaagggggctgtgccctgcgaagccacaggggtggagcttgccaaggccatgggagcctacatcttgcatcagtgtgacctggatgtgagacatggaaccaaaagagatcattttggtaatttaatgtttaataattgccctattggattttgtgcttgcatggggcctgtagcccctttgttttcactaatttatcccatgtgaaatggtgtatctacccaatgcctgtaccccattgtatctaggaagtaaccaacttgcttttcattttataggctcataggtggaagggacttgccttgtctcagatgagactttggacttggacttttgagttaatgctggaatgagtcaagactttaggggactgttggaagggcatgattgtgttatgaattgtgaggacatgagatttgggagggtccaggaccagaatgacatggtttggctgtgtccccacccaaatctcatcttgaattgtagttcccaaaatccccacgtgtaatgaaggagatgtggtgggaagtaattgaatcacgggggcacttacttccatgctgttcacatgatagtgagtgagtcctcacaagatctgatggttttataaggggcttttccctgttttgcttggcatttcttcttgctgccaccatgtgaaaaaggacatgtttgcttccccttccaccatgattgtaagtttcctgaggcctccccactcatgcagaattgtgaatcaatcaaacctctttcctttataaattacccagtcttgagtatgtccttatagcagcatgagaatgaactaatacagccaatgtcaagaaatgtattccctgggttgtcttccaggatttttatagttttaggtcttacatttaagtctttaatccatcttgagttactttttgtatattgtgagcagtaagggtctaatttcattcttctgtatgtggtttgccagttatcccagcactactttaacaatatagattctttgaatctatgaacatggaacgtttttctacttgattatgtcatctgtgatttctttcaacagtgttcccttttatccacattctcaccagtgtcagttattttttgtctttttaatagtagccattcaaactagggtaagatgatatctcattgtggttttgatttgcattttcctgataatcagtgatgttgagaattttttttcatgtagccattggccatgtttatgtcttcttttaagaaatctctatttgtgttctttgtccactttttactgggattattatttttttttctgtggagttgtttcattccttgtatattctggatattagtgcctttttggatgaatagtttacaattattttctcccattcagcagagtctctatactgtgttcatttttttcctttgctgtgcagaagcttttcagcttctactaatcccatttgtctatttttgtttttgttgcctgtgttgaggtcttagccataaaatctctgcctagacaaatattctgaattgtttccctatttttttctagtaattttatagttttaaatcttagatttaagtctttatttcatgttgagttgatatttgtgtatgaaggatatgggtccagtttctttcttccacatatggatatccaattttcccagtaccatttattgaagagggtgttctttcctcaatgtatgttctagtccctttgtcaaaaatcagttcactataagtatctgatatactgattttgtttccttcggataaatacacagtagtgagattgcaggattgaatgatattctatttatagttgtttttgagaaatctccacattgttttccatcatggctgtactaatttacattcccacaccagggagtatttccacgttctctattctgttccattgatctatgtgtctatttttataccaataccatttcctcttttggttactatagccttataatatattttttaatcaaatagtgtgatacttttgcctttgctctgtttgctcaggatatctgagcaaccaagtacagatgctcctcagcttatgatgtataataaacccatggttaagttgaaaatattgcaattcccaaatgcatttagtacatctaaccttctgaacatcgtagcttagcctagcctaccagaaacatgctcagaaaacttacattagcctacagttgggcaaaaatcatctaatacaatacatattttgtaataaagtttgaatatctcatgtactttattgaatgctgtactgaaaagagaaaaaataatggttgtgtgggtactcaaagtatggtttctgttaaatgcatatggctttcacatgatcataaagtagaaaaatcctaagttgaccctttgaatgttggaaactgtgtgtattgatggtgcggagtaatgaagatttttacttgctttgatcaatttagaaagcaatctgatttcatacaattaaaaatgtatatgccctatatatgcataaggagatatatataaagatgtttattgcagtattatttataataaaataatgaaaaattaaaccattaattaaagaatgggtaagtaataggtaatataatcatgtggtaaataccacaggtaggcaaaaaaatagctgccatgacttggttaaatgaaaagactggatagatttgagtcctggccctgtcataactttggatagttacttatacttttcctgcttcagcactgtaaaatatagataatgctatggtttggaagctctctccaaaactcatgttgaaatttaattgccaatataatattattgcaaactggggactttaacagatgattaggtcatgggagtttcaccctcatgagtggattaatgccatcattgcagaagtgggctagttattacaggagtgggctcctgataaaaagataagcccagccgccttttgttctctctgtctcacatgcttgcttacccttccacagtgggatatccctcaccagacgctggcaccatcctcttggacttcccattatccagacccatgagccaaataaatttctgttctttataagttactcagtgtgtggtactctattataacagcagaaaaaaagacatactattcatactgaaaagtgaggctgtcattatagcaaagtgctgaaaaggtggaagcagctttggaactagataatgggtagaggctggaagaatttggaggagcaggctagaaaaagcctagattgctgtgaatgtagcattaaaggcaactctggtaaggggtccaaacaagaggagagctgtagggaaacatgaaactttttagagattacataaggggtggtgaccaaaaggctgattgaaatattaaaggtaaaggccattttgatgaggtttcagagggaaatgaagaacaatgttttagacactggggtaaagtccatccttgttttacagttgtaaagaccttgagtgaattgtacccaaagcctgagggctttgcagaatgcagagctttaaagtgatgaactaggatatctggtggaagacatacccaagcagcaaagcattcaggctgctgcatggctgcttttaaccatatacagtgagacgtgagggatgacttcaataaagattgtataataaaataagaaacagagtgaaaggatttggaaaattcacagcctggttatgtaaagaattaaaaaaaaaaaagaaaatttcagaagagagcactaaggatgtggccaagtgacaattgccaaagagattaatatggataaaagccaggtgctatatatcaagaccatggaagaaagaccctgaaggcatttcacttatcactgaggttgccccttccattataggcccagagctgtaggagggcagaatggtttctggtgatggtcttgaagcatcctccatgggctcactgcccagggttaacttgggtctccactcattgtgattctagcaatgtgcccctagtctgcactgggagcatctcatatctaacattttgatttaacccttttccaagtgggcatgcccagtcagggatctggtttagctctccctgatctactttgccccactgcccaggtttcccaaatcacagaactcataatccttgtgattacttgctcaatgctttgtcttttatataggattgttagcttaatgaaaactgttaagcccgaatattgtgtttaattcacagcagaagatcctaaatgagtaatgaatgaataaaaattatagaaatatatgcgtatatgttaataatagttgggtcttacagagtatttcaaatagtagccttctttccactcatctgaatttggagctatttagagatagacacacaagcatatatgcttccatttaggatagatgcaaacatatagacatcaaaatatcagctttatttctgttgaaactatttgagaatgtgtctagggactgtgggcaaggagtaaagttattcctaaatttgacagatttcccccactcaatctctcattacagggagatggctaacttcgtatatattacagttcatatcatattatgtgtgtatgtattacacacacgtatattacacacacacacatatatgtttatgtataggtcatctccctgccatatatatatacacacgtacgtaaatgcacagagagcatatgcactttattggcagcaagattcaatggggagcaacgaaaaggccagagacactcaagttcagtttcttcttcccaagttctggattcttggagaagtgagggaggagtcaggcaacttacccaagagaagatttcaggaatagagaataagttatctctagaagggggtaatttgggtttttggtttttggtttatattttctatgttttccaatgatcatgcactatttttaatcagataaaaattcctaaaacataaattgcaatcttaatttttcttggcctcttattttctcacaagtgttaatttggccaattcacaatatacatatatgcctgtgtaaaattgtagatctcctgtgtgggaatgaaagaagtatctgatggagaaaatgaacaaatagcttaaaaatatataaaagagaaacatctatattaactattcacaattacttggggatagcttcttgtgtgagaaaattatattttaaatgaagtggctggtgccaagtgatatgagtactaatttttttttaatgatactttggtaatgtggtcaaaatgtgaaataacttatctttttttttcaatatttttctactacttctcagtaagcatgagttttgttggaattattgtgaagttttagagttagaatgtaatctttttcgtaatttcacagatcatattaaaatttacaaatagttatattgcttatagagccacagtgaggggtcaggtttcttattctgccagttaatgtagtgtctgctttagaatactgtcatctaccctagttcacaatttttgaagatcttgtgaaagaagatatgtagggaagtcaataacaatgaatcttccaataaagaaaaggaagaaagttctcattcccttattttttgaacctaccttttaacagatggttttactgctctattacacagcataattggattgttttatctgaaagtgaataataaagacaaaactttaaaaatagaactgtttgaactgagagctcacttttattaagagaacttgtcctatgaaaattattatttggaaacagaaaccaaagtacatatattaaatagcatcttttgcaatcaatgtcaaggctgtgttgtgtctttggttgtcttttggtaaatctacaaaggagcatcaacttagtgtcctcataaaagacatatatgtgttccactacattcagtgtgaacaatattttaatttagcttgccaagatatagtgaaatagaatttttgcagggtgattgttctgttaaaaatatataaaagggcctagaaaatgatcttttggctaaagctgtagaaaacagactgccattgatttgcagaatatgctgtttgatgtttagacagctggaaaaagtttggtaggagaactttaaaaacctgttataattgtagccttgagtatgatatgatttggcaactaagagatcacctcacaaagctatgatccacaggcaatgcagtcttaggtattataaattcatatttatatcaaaaattccaaatatctattgagatattgtgatagaataagaatacacattttggtcttctttcccagctcctggccagacctcctgaaactcttgtaagtgctagtgataagagctataggagcaccttttattataatgtaattggtttttgttcctagctcttgaaatgcttctaaaaatgtgaaagaataaccttttgctagtcataacaagccccattcaactacacttgaatttatgtcaacgaagtgacttgtggaaagcccctaagggtgggggtcactggttgtgaaggaaatcaacaccatgattagagggttggaatttttagcactcccatccaaacctccaaggatgggagaggggcttgaggttgagttaatcattagtggccaatgatttaacaaatcatgcctatgtaatgaatatcctaatccttcatgaatgtcctaatcaaaggagtttggagattttccatgttagtgaacacatggagggctgtaagtctcaatctccaaactatacaaaccaagaacaaataatttcacacaaatcctttgccattgacattaaccagaagacagggtactatataaacccaaactaatattttaagcccccctaaccaactgaatggaaccctcttctttgccaagggcattcaaaagttaaactgaaaaactagttcagtctgtgatgggaaggggggttgtacgtgcttcattatacactcctccctttacaattcgggcacaactgaacagcattaacattaaaactgacaccttaagaatgacaaaacagactctttgcagcaataaaataccaaattccaacccgactctattataacatgacatggcaaatagcaggccctgaaggaaagcaacatgttttacctcaaaatacatttctttgatgtatttttttaaattatactttaagttttagggtacatgtgcacaatgtgcaggttagttacacatgtatacatgtgacatgctggtgcactgcacccactaacttgtcatctagcattaggtatatctcccaatgctatccctcccacctccccccaccccacaacagtccccagagtgtgatgttccccttcctgtgtccatgtgttctcattgttcaattcccacctatgagtgagaatatgcggtgtttggtttttgttcttgcgatagtttactgagaatgatgatttccaatttcatccatgtccctacaaaggacatgaactcatcattttttatggctgcatagtattccatggtgtatatgtgctacattttcttaatccagtctatcattgttgtacatttgggttggttccaagtctttgctattgtgaatagtgccgcaataaacatacgtgtgcatatgtctttatagcagcatgatttatagtcctctgggtatatacccagtaatgggatggctgggtcaaatggtatttctagttctagatccctgaggagttgccacactgacttccacaatggttgaactcgtttacagtcccaccaacagtgtaaatggaagtaaagctctcctcagcaaatgtaaaagaacagaaattataacaaactatctctcagaccacagtgcaatcaaactagaactcaggattaagaaactcactcaaaacagctcaactacatggaaactgaacgacctgctcctgaatgactactgggtacataacgaaatggaggcagaaataaagatgttctttgaaaccaatgagagcaaagacacaacataccagaatctctgggacacattcaaagcagtgtgtagagggaaatttatagcactaaatgcccacaagagaaagcagggaagatccaaaattgacaccctaacgtcacaattgaaagaactagagaagcaagagcaaacacattcaaaagctagcagaaggcaagaaataactaaaatcagagcagaactgaaggaaatagagacacaaaaaacccttcaaaaaattggtgaatccaggatctggttctttgaaaggatcaacaaaattgatagactgctagcaagactaataaagaaaaaaagagagaagaatcaaatagatgcaataaaaaatgataaaggggatatcaccaccgatcccacagaagtacaaactaccatcaaagaatactacaaacacctctatgcaaataaactagaaaatctagaagaaatggataaattcctcgacacatacactctcccaagactaaaccaggaagaagttgaatctctgaatagaccaataacaggatctgaaattgtggcgataatcaatagcttaccaaccaaaaaaagtccaggaccagatggattcacagccgaattctaccagaggtaaaaggaggaactggtaccattccttctgaaactattccaatcaatagaaaaagagagaatcctccctaactcattttatgaggccagcatcattctgataccaaagccgggcagagacacaaccaaaaaagagaattttagaccaatatccttgatgaacattgatgcagaaatcctcaataaaatactggtaaactgaatccagcagcacatcaaaaagcttgtccactatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggaagtatctcaaaataataagagctatctatgacaaacccacagccaatatcatactgaatgagcaaaaactggaagcattccctttgaaaactggcacaagacagggatgccttctcacaccactcctattctttgagatattttgaaaaggccctgcaaaactgtctcttgtgggaaaaatctacattctgtagagaatccctttccctttccaggtcttttccctgatttaggagagattaactaagagtctggcacctttttaagcctaataagaaacatttacaatctattctctttgaagcctgctacctggaggcttcatcttcatgataaaaatcttgctctttacaatcgcttatcttaagcagacactcctttctattaatttcaggtcttacataataacttaactctttcaaccaattgacaatcagaaaatctttgaatctacctatgacctagaacacccctaccccttgcttcaagttgtcctgcctttctggaccagccagtgtacatcttacatgtattgattgatatcgtgtgcctccctaaaatatataaaaccaagctgtagctcgaccaccttgggcacatgttctcaagacttcctggggctgtgtcgttggcaatggtcctcaggtttggctcagaataagtctcttcatatattttacagaatttgactcattttgtcaacaacttcaaaccaagttatctgtaaatagaaaacaataataatgacaacaacaataccaatttcaagcagagatgtttctcaagctcccagatctccaggctatgtggagaacaaagtgaatctgggggaaagaaaacagcatggaagagataatgagagaacagagagcctatgagtgaactaaaattgtccccagaaagagaaagtttaccctaggaacaaaaatactataaatagtactggaaattctataagaaagttatttttttaatatccaccagcaatgttttgtagttttaagcatatgcattttatacatcttttcttaaatttattaccatgtattttgtttttttatttatgataaatcaagtactttaaaaaaatttcttccaggttatccattgccaatatatagaaatacaattattatttgtaaattgactttatatcttgagaacttactaaattattatttatgatgactttcatatagattcaggattttctatgtacacaatcatgcattatgccaataaagacagttttagttccttctttctgatctgtatgtcttttatatttttttctaatgcactagctatatctccagtacagtgttaaaacagaaagaacagacatctttgcctattccttatctaagagcacagtattcaatcattttaccattgatgactatagtaactgtatgttttgtataggtctcctttctcaaattcccttttctcctagttttaaaaatcataaacagtattgaatagcatgttcatattttgagtctacatttatgagaaactcaatattattaagattttgattctcaaaattgatctatagattcagttgatctatagacactattgatctccattcaatctatagattcaatccaacaaaatctcagcatgctttttttgaagaaaataataagctattaatgtatatggaaaagcaaacaacctagaagaaacaacaattttttttaaatgaacaagtttaattagactacttggtttacagatttgctgtaaactacagtaattgagacagtgttgttggtgtaagcacggccatgtagacaaacagaacacaatcaccagtacagaaatagacccacacttatgtggccaatttattttagacaatggatccaagataattcaattagaaaaggttaatcttttcaataaatagtactggaactaccaaatattcctataaaaaattaaccttaactcttacattacaccatacacaaaaattaaattgaaatggaacataaatgtaaacatataagctaaaactataaaccttctataaaaatcataagagaaaatttttgcaaacttttacaggaaagatttcttaaatataacacaagaatcacaaaccatgaaagaaataaactgacacaattaactttatcaaaacttaaagaaacaatttttttgctctctgaaagacacagttgagaaaacaaagagacaaaccacagaatgggagaaaatgttttgaaaatatatattttacaaagtactttatccagaagatataaacaattcttataactcaatgagaatacaaagaaccttcacaaatggagatattaatagctaataaactcatgaaaaactgttcagagttctgtcttcatgaaaaagaaaactaaaaaacaatgagacatctctacaccatcatcctcaacaagggtgatatcatccccaaggtagcaaaaattagttcttaggtacagaggaaaattttctatattgtataatatacagattttatatgtacatataatacatatacacacagtataaaacagatactattaaactactaatatatgcaaaacatcaatgaatcttaaaaagcattagactaagtagaagaaaatcttaatatccacatacaggtatacctcatttgattgcactttgctttattgtgcttcacagtattgtgtttgcaaattgaaagtttgtggtaaccttgtattgaacaaggctatcagtgccatgttcccatgttccccaagcgcataggctcacttcgtgtctttgtcacatttcggtaattcttgtgataataaaaaagtttgaaatattgcatctgtgaacatgatctgtaatgctattattgtaattgttttggggtaccacaaactgtgactgcataaaatggcaaaggtaatagataagtgttgtgtgtattctgactgctctaccatagcacatagtagagcagatattctcccctctccctctccttgaggcttcctattatatgagacaaaacgatatcaaaattaggccaattaataaccctacaatggcctctaagtgtttaggttaaaggaaaagttgcacatctttcactttaaatcaaaagctagaaataattaagcttagtgaggaaggcatgtccaatgccaagacaggccaaaccctaggcctcttgagccaaacagctagccaagttgtgaatgcaaaggaaaagttatcagaggaaatttaaagtgctgctccagtgaatacatgaatgataagaaagcaaaatagctttatggctgatatggagaaagtctgagtcatctggatagaaaatctaacaagccacaacattcccttaagttggagtctaatccagagcaaggccctaactctattcaattctatgaaagctaaaagaggtgaggaagctgcaggagaaaagtgtgaagctagcagaggttggttcatgagattcaaggaaaaaaattctctccgtgccataaaagtcaaaggtgaagcaacaagtgctgacacagaaactgcctcaggttatccagaagttctcactaagatgattgatgaaagtggctacactaagtaatagattttcaatgtgcatgaaaacaccttctattggaagaagatgccattgaggactttcatagctagagagaagaagaaaatgcctggcttcagaacctcaaaggacagcctgataaggcagctggtgactttaagttgaagccaatgctcattgattattccaaaacccctaagttccttaagaattatgctaaatatactctgtccatgctctataaatgaaacatcaaagctttgatgacagcacttctgtttacagcatggtgtactctatactttcagcccactatggagacctactgctcagcaaagaagattcctttcaaaacattacttctcatttacaatgcacctggtcactcaagaactctgatagagatatacaaatagattaatgtagttttcatgcctgctaatacaacatacattctttagtccatagatcaatgagtaattttgactttccagtcttatttaagaaatacattttttaaggctataaatggcacaaatagtgcttcttctgatggacatgggcaaagtaagctaaaaaccttctggaaaggattcaccattttagatgccatgaatatttgtgatttatgggaggtagtcaaaatgttaacattaacagcagtttggaagaagttggttcagatcttcagggatgattttgagaagttgaagacttcagtggaggaagtaactgtggatctgatggaaataacaagagaactagaattagaagtggaacctgaagatgtgtctcaattgctgcaatgtcataatcaaacttaaacagatgaggagttgcttcttatggataagcaaagagagtggttttttgtctgttttttagagggaatctactacaggtgaagatgctgtggacattgttgaaatggcaacaaaggatttgtatataaatgacatgagtaaaaccacaataaagtgatatattgaagcctattgaataataaaagaatatattggttcatactgaaataaacaaatagaagaaagctcttccttatattggattgccaactaacaaatacaaaagaaataatagaatttaaaaattaccacttggcaatcatcatcatcatcatcattgactcaggtgggaaacatcaattaaggctaaaactggtgggtgcaggtttgctgaccatgtgagtttcctagggctgctataacgtatcatcataaatgtggtggcttaaaacaatagaaatttattttctcacagttccagaggccagaaatctgaaatcaaggggtaggaaggaccaagttgccttgaaagatctccgagaaaattcttccttgcttcttccagcttgtggtggctccaggaacaccttcgcttaaggcagcataactccaacctttgcctttgtcttcacataaccttctttgttgctatgtctgaattttcctctgcctttctcttacaaggatatctttcactggatttagggctcaccctaaatttcgggtgatatcattttcagatccctaattatgtttgcaaagaccctttttccaagtaaggtcacatacatagattccaggtggacaaatctttggaggagtcacaaaccaatgcacaacagtgaaaataggatatttacagagtatctcccacaatatacttattaagtgccaagggaaaagtagatactccataatggagagacctggcaaatcaaggtcaatgtcatcaatagtagtacaaatgtatattgcatccctccatgcgtgatgcactatgaagagtaccgtgtcacttctaccacatttctgccaaaaatgcataatgtgaatctaattctgagaaaacctgcacaaatccaaatggagtggcattctgatacttccagaaacctcaaagttatgaaagacaggaagagaggatggagaggcttggctagttaaaaattgtactagaaaaacatttcttcagctctaaaagacattgccaggaggtaataatatttgagtaaggtctttgggtagagacagcgttttatcagtgataatttcctgattttgattatcgtgttgtgtaggagaatgtgtttattttatggggagtacacactaaagtatttatgggcacagggacattatttcaataacttactcctagagagtttagaaaatactatgtatatacagaaagaaaatttagtaaatatggcaaagtgtgaatatttggggattctgaaaagtatgtggcagttctttgtataactgctgtaacttttctctagttctgaaattatttcaaaataaaaagtaaaaaaaaaaagacttttgaagaaaatatctacttaccccagaggagtctggttcccaaaattcattgtggctggaacactgatgtgatatatgttttaatgcatataagctggtccctggcaactaagccagtgacctgactggttttctgaagcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaacagatttattccagttgcgtaaaacagtatattaaattctgaacctttgggggaaaacaacatatgtaagtatagacgttgagctgagaatttagaaccccgagcttgtcattcttattattatttggggatttttccgatgaggtcagaagccaacccacctgagtccccttcatcatcacttttctactaaagtccccatttagtagctgctgagttgttcattctaaaccttgcctttaatggacatttcattctattaaaaaacctgtgataatttaagtaacttttttgccactgcatgttagagattacaaatatcacatttttcactgcaagccatttatgtaccttatacaatatcagtcaacagtctcttaaaggagagtttcgacagcagaaagacatttaagtcagagaatatatgctcacaaaagcattagaaatattggaggatcaaagatcagggaaagctgctgctggctgtaggttttagaaatctctatcaagttttagaaaaaaatcaggaaggtgtggaaccagtgtcttcactgcagcactgacagtcatgatttgcaaagcacctggaggctagtgaaacactttctatctgctgaagctcatagagctgactgtcactgctggaggagcaaagtagagctttctgcctgtctttcaccttccaaatctcataactgctttttgctgttgcacctaacccagaactaaagaagttacttgtttccagccctgcgatacaggaatattagagaaaagctgagactgtgctaatctatcactagacaaactgacatagtggttaagagaatgggctttgaagctccggagccagatcacctgggttcagagccaggttcctccacctactatttctatgaccttggcagggtgcccaatttctttgtgcctcagttgtgacagttttgaactgtagctaatctccctacctcaaagatttttaagagttagttcaatatactatatgataatgcctgacatatgtatttctttgcaggaacatgggtaaagctggaaaccatcattatcagcaaactaacacaggaacagaaaaccaaacacctcatgttctcactcataagtaggagttgaacaatgagaacacatggacagaaggaaggaaacatcacacactggggcctgttgcggggtgggaggcaaggggagggagagcattaggacaaataacataatgcatgcagagcttaacacctagataatgggttgataggtgcagcgaccaccatgacacatgtatacctatgtaacaaacctacatgttctgcacatgtatcccagaacttaaagtaaaataataaatacataaggacagaaagaaagaaattattactaaaatatatgaatgtagaaaatggttttgcaaaaatgcaaataaagtgattaggcattgcataatctgtttggaactctttggtactcaatttttttttttatttgaggtatttctttccacgggaaccataactatttaactattttaggtttacgttatgtttgaggctaaatatactagcagctagcttatgtttaatcagcattgcttttacataaaggacactcatctgaaagctcaaggtagtatacttaagtcattatattttactttttcatgaaggccaaggaaaaatgccacaggtctttttactcttcttggtaggatcataattttgttaaatgtccataaataattaagatgcctctaaaggtttgctccataactataaagtaataaaacaaaatcttccaatttgaatttctctggaagcattgattgcaacttaatcaattaaacttttcacaaattgactttataatttcataatgttttaaattcattcaagactaggtatactgtaatagattgtaaaaaaaaaaaaaaagaagtcgtgagtcttcattctttcccgtatctatgtcctttccaatgtgaaattgtagcttcttgcataaagacgtgaaatcttcccgatccctttaatatgggctgcacatgtgacttttttttcccaacaaaatgtaatggtactccaggttgaggctttgtgattctttcttgctcctctgcctttatcatgagaagatgctcaagctggcctgttagaggatgagacttgtggaaccatatggagcagagctgattcagcccagttgtctcagttaaagccccagatgtgtgagagaggccagttgaaattagcaaagccagcctatagctgaccaatgatacacagatgagccaaaccaagcccacttcatattagttgaatttctaggagacttttgagaaaacaaaacaaaacaaaaaacactgtacgtcttgaaggttgtgtagttggttgtaattattgcagcaacaggtaactgtacatacacagtgacatgattacaaactgagcagtaagtatatttaaattcaaaaagtatttttgtttagcaatgttataatagtagcagtttcatctttttgatgctttttctaaatatacaatataatgctttcaaaaacattaatttagggaaaatttagagcatctgcattcataaccaaaagtatgtttatatttgttattctaccaagggtctataaaacaagtctaaagaatttattcattggcaaaatgaattttgcatggcaaaattttatggcaaaacatacaaatcagaagcaattattcattccttgcattttgcattctacactaacttgctgcctacgtcgaagcaaacaaggtaatttgaataaataaatggtttctctttaataatgttgtgcagcagggaagtcagcttctaaagaaatggttttgaagtgattaagaagaaaaagctttataagtattttaaggctattgagttactctgaggataagtaggataaatgttatgagtagaaagcagagcaaggtttcaagcattcagcaggcaaggtttcaaaacataatattagttggcataaataaaaataaaagttcttttcagtattgcttgagaaaggcaaaagtggttatttccagtcagcccactttaattcagtacctggtgaagttttccagctggggcatatggcgcatagaaatgacttatcaaaagaggggcttcaagatagttcaagaaaagttaatcttttacctataatgtgttagccattctgctaggtactgagaacagagctggccaaagacaatgattttaaatctgtgtgaaatgcagaataatagtatatgcaagacatgagaaacaaaatttgtctatgtggctagagaatgattcacagaggagaaaaccaatgactgggtctcgatttacgtttatagtttaccatttaggaaaaaaggatgacagtaataaaaaggaacagtataaacaaaggcatagggatgtgaatgagtgagtcacaatggaaaattccacccaccaggaacatggataacccaggacagaagaggatggaggtaaaatatgatagtactgatggtatattagttatttatttctgcaaatgaattagtgcaaaacttactggcttaaaaacaacaatattaatctcacagtttctgtgggtcaggagctcagcatggctcacctgggccctctggctcaggatctctcaggctgccatcaaggctgctgtcagcctcatctggagggacagtgcagggaggatccacttccatgctcactggtcatcagcaggatccagtttttgttggctattggcctgaggccaccctcagttccctgccaccctccgtaggcagttctcaacttctcagcttgtaagcaagcatggagagccagagagagtgtgagcaagatggatgtcaatcttttgttacctaatctcagacgtgacttctgtcacttttgccatattatatccattaaaagcaagttactagatccaacccactcttaaggaagtgggaaggaatataaagcaaggacatagatagtaggagggagggatcattgggagccttttagaagcagtccccaaaagatggtaaaagtaattccatccatcatgagtgacagtactaggaaaagaggtcggtgataaggatacatgaaattgatgagacagacagttggtaaatgatagggaacattttagtgttctactgaaatgactagagagcctgcataggtaggatacattgatccctgtgagtagggctaaacaatgctaacaatgatcacctgagacatctaggaaaagaagagcttcgaatgcccacgtggtggagacttgtttcttacttcttctacacaggcaagatgctgctggagggatgcttgcagcctaacctgactgccaaatatgaaaagagaaaagaggaggtgaaggacagagcacaatatcaatgcatccaagttgtccagtggccagagacagaaatctgaaataaaacaaccagcactggttgctcagagaaaaaaaaaaaaacaaagcttatgacaaaggcaattttcacaaaaataatatcaagaatattttaaaagataatttagaggattaaaaaacttcattaaaaattatttttgaatgaaataattccataggcaagtggaaagaaatgacattaacattgagaactgaatcagaaactgaaatatcaagttaaagaatcaggtctctgaaaaaaatcagagaccaaaaggaatgcgatggaaataatgaatgcaaatatgtaaataatcttaattcttaaagaagaaaaacatatcaagaaatgacaggcaatcactaaatatatgagagaaataagctcttggtctcaaaaagactttcttctccaaaagattgaaaggaaaatgaaattccattattaatgttttaaaagaaactcctgatcatatgttagtataattactgaattctgagaataaaacaatttatcctattgtaaattatacaaattgacccaaggagatacacattttcttctaagacactctctttcagccaaagtggtttatttgctattcattaaatgcagggcaccatcattcctagtcccattttcttctagtaggagcagcctttccccaactacacagttggaattggagagccaaagagagtgctgtaataattacattaagactagcagcagggtacaggaactatcccaggcaaatctggtcctgtggttctccctacccagatcttcagaaggctcatccttgcgatgcccttaggactttgcttaagtgtcagcttatccacttccctgaccatcccctagtgaattaatgaactactactcatgcaagcccccttaccctacttgatattttgcctcatatattatgcatttatttgttatatctctccacctgtcttagttaatttgtgctactacaacaaaataccagagacaattgtaaagaacagaaatttgttttcccatagttccggagctttggaagtccaagatcaaggaactgtcaggtttgattgtctggagagggctgctgtctgcctccaagatggcaccttgttgctgcatcctctggagaggaggagtgctgtgtccttacaaggtggaaggcataagggcaagagggccaaacacctagtgaaggctctttcataagggttttaattccactaatgaagaaggatccctcatgacctaatcacctcttaagagccccacctcttaataccatctcgttggtcattaagttttaacacctgaatttttgaagcaatacatccaaatttatgtccctcttagatgaaaaatatattcagtccattcccatagcccctaaagtattaactatttctagtatcaacttaaaagtctaaagtccaaagtctcatttaaatatttctcaatcagatatgggttagatgcaaaggtgtatatcatctgtaggcaagtgtccctttagctgtgaatctgtggaattaaaaaagttatgtgcttccaaaataggtggtgggatgggcacaagttagatgtttctgttccaaaagggagaaacaggaaagaagaatgaggtaactggtgttaagtaagtctaaaatccaacagggcaaacaacactctatcttaagccttgagaataatctttgactccatgtctcacattccaggaacaatggggcaagggttaggtccccaaggctccaggggactacaaccccatggctttactgagtgtaccccaagcagctgccctcacagattgaaattgggtgcctacagctctcccagactggcattccgcattggtgacagatctaggctctctgaggtggctctgctcccatggctccattaagaattgctctactgggggctctctgcagtggccccaacccctcggctctgctgggcttttcccaggttggggccttattcaacacatgagcaacagtcctctccctgggccccgatcctctctgaggggcgtcctttgaaatcttggtggaggtgaaatcatgccaccacaggtcaaggactctgtgagcctgttgaattagcatcgtgtggatggattctcctgtttatagcattgtggcttacagatcatgccttgcagagcagtggcccgagttctacctggcccactttagccaccgctgaagtggccagtgagcactgtaccagaatatggaaagaaaggacttacagtaacgttgggtggaaagccctgaggccccacagccaccctgggctcctctcttccagcttttctgttctcaaggcctagcactctgggtgtttgatgggtactgcagcttctaaaatgccttcagtgtcgtgctcccattatcttaatgaataatacctggcttccttctattcataataatcttatcaaatggtctcttgggtataccgttggttttctctcctaaacaagcttttaaaattctgtacatggccaggctgagcattttttcaaatctttatattttacttttgttttaactataaattccttcttcagttttttttctctcttctcacattttactataaacaggagaatccatgtagcaccctgaatactttgcttatagagatttcttccaccaaatttcctagttcattgcttttaagttctgcctcctacaaagtcctaggacatagacactgttcagacaaattatttttcactttataatgaggacagccttttctacagtttccaataccttgtttcttatttccatctgagacttcattagaatagtcttcgctaaccatgtttctaccagcattctgttcacaaccactttaagtaatctttgggaagaatgaacctttccctgtagctctgctcttcttctgagccctcatcagaatcacccttaacactccattcatggcaatacaggcttttttcaacatttacttcaaaagttttccagtctgtagccattacccaattccaaatctacttccctatattttggtatctgttatagcaacacccacttctttggtactgatttctctcttagtccatttttatgactataacaaaatatcacagactgagtaatttttaaagaacataaatttatttcctcacacttctgaaggctgagaactccaagatcaagatgtgggcaggttagttgtctggtgagggctgttctctggttccaagatggcaccttgttgctgcatcctctggaaaggagtgctgtgtcctaagatggcagaaggcatatgggcaagagggccaaacactgagtaaagctatttttataaaaggcttagtcccatttattagaaaagagccctcatgctctaatcacttcttaaaggccctacaatagtacttaataatatcatgttgcccattaagtttcaacacctgaattttggaggagacatgctcaagccatagcaccacttctatgagagcagggccctctctgtttagtttactgctgtatctatccttgtgcctagaacagacagtggcatgtcataggcattcagtaaatacggttgaatgaaccaatttttgaattaatgaatgaataaatgaacaaagcagaaaaattatatagatcaatttccatagaaaaaaattggaaggggattagcagatggattcaggtgagaccgcatagaataacggttctatgctagagaatagaacttaataatgcttaagttctagaatatgaatgcctgaggttcttagtttttttttttttttatcttatcttttttcctgcatggctctagacacatatggtttgatttctttatttccaggtctcctcagttgcgaaattaggatgttaattatagcttttgacatacaagaaacatcaaaaagattgaatgtcttaataagagtgaagcatgtagatcagtgactgctatgtaagtattctaatattattttgatcttttgaaaaagagataataccaacactacttaagctattctgatgaggaaaagataagaatagcataacagtaatgctaagccttataaagactgactaaatctcacttttaactagagaaatatcatttatgactacagatttttaaaaggcaaactattagcaatctggaaattagctgtgtgtcaaaagaacactggattatgacctatgaaaaaatatgaatgcaaaggtagtcaatagtaaattatcaaattatatcattatgtaaacacaacatagcattttaaaaactataattgtacaatcacgttctaaaaaggcatttcaaataattcagcagtctttcctgattaaagtgctaaataaaatataaatttaaaaaacttttaagtataaaacagggtcttcaccaaagtccaaccggaaaaattctaaaaagtgaacttttaaagccatttttattaaaataggaatcagacaggtatgcctatgatcactgcagatgttgttattactattagtcaacatgaaagttttaaaacgtttgcgataagacaagacaataaacaacactgacaaaagatataataaagtcaaaagcttttccatagattagaaaaatatttaatgtacagaatatttctgcaaattaataaatgacaattagtaacagaattattggaaatatgaataggaaattcacagtaaagtaaatttaaatggcaaataaacatgaaaatatgttcaacctagtaataaggaaatgtaaattgttttaaaagttacagaataccttttctatatcagattggtaaatataaaaaaattgatcatacaaactgttaataatagccgacatttataatcaagtactgatttatgctagggactttttcatgttctatgtatatcaagtcatatattctttgtaacaagcatatgactaaaactaatattagtctaatatatcaatactggtattattattcctattttacacccaattaaaccaaggaatatagcaatttagtaatttactcaaggtctcacaggtgaaaagttgaagagctataattgatccctagcagattgaccctagagattgctcctttaaccactacactaaattttctcattgctatcagcaacataagtaaagtgtccttctcatatatagctcattgaaataagaattattatagtttttatagagtaacccacactatttattgaaattagaactatggcctttggcccctcacttcacttctaggtttgacaatatttatttgtgaataagcattccaataggaataaccataagcaaattcagggaggtagaggaacacacagtttttaaaggaaaaatgaggagggtcacatacatttttttaagaaaattatccttggctacaagtatcaataatacgggtggcatcagtccaaagttggacaggcagttgctgggcagatatcctcatggaagtatcgtgtgtgtgtgtgtgtgtggggggggggggtggggctctggtggcctttgtgcaagattgtgtttttatgcagagtgttttgtgatagttattttatcagacacaaatgcctgaggaccctcccctcatggccttccgcagctccatttgtcagggaagtggctccattttgattctgacaactttcacacactttataggaaaaaaaagtacatgaatgtaaagatgtgtacaagattgtttattgcagcatgtagtactaaggggtggatgcatagcaataggtttaatgattgaaaacgtattgtatacttgtaatgaactttgtggttgtttttataatatccattcccattttcttaggatcaaatttatttcgacaatgtttcagccttcaccctcttgccaatagttcatgttctttgagagggagagtaacagttgactgcatttctagttttaaaagtggtacatgtgactgaggctttatcactgttagcaaattatcaaaagcaaataatgttgaacattgactgagaaaaaaacataattctggacatcatcttcagaaagtatgattcaatagctctagagttactcctccaagaatctatgttttccttttttgttaaccaagctctccaggtgtttctcatgcacagacatgtttaaaaacaagcatgaatatcgtaaatgtcaatgctgtatggtaaatatcacctagctgagactatgaattcatggaggaaagtgtaattaattactaaggtcagaggtacaggcaagatttgacactttattgatttttgagtattaagtgagattttgtttttgtgaggagcgtgtatgaccccccaaatagaagatagtacagagtggattcttggaagatggtgcagcataaagcatgtgaaatctttctccctaactagacaataattgcactggcacaatctgtctgatgtaactattttggagctctacagtgtattgaaggcttgcagttgaagacttggatgataacttgcagttaatttcagtaaatttcaactcttggcacaaaaccatccatcccctacctctcagccacatgacaggtagatctgcacatgtacctggaatagcttgaacatagcttgaagaagcctgggtgcacaaaaaggaccctttcctttatatactggggatctatgccctgattgttacttctgattgcagatgcacaaagaggctaaagccattgttgttttacctcctcccattgctgcaagcccttccccttctgactgaagtgactgccagggccaatgacttccccttcaccttcatttttctctttttccactttgtgagccagacattgaagactagctcattgaaaagaaaccacatacacgagaaaattagaaagtcaccactcatgcccaggggaaggcactggctcagaaaaggccagagaatacattaagtttgcccctgtggtttattcttggcacagagatagatagcctacaacaatcaagaaacaacaacaaaaaaagcagcaaatcctggtgaagaggaaggattcagtttccagcattgctgtaccattagattaacatgtctagttttcaccagaaatcataaagcatatttacaaaccaggaaaatatggctaattcaaaggaaaaccgcacaaacttcccctgacaaagaactgatagtggagctatgagacacagactttgaacaactgtctcaaagatgctgacagaaccaaagcaagacatgaagaatgccaagaagtcaatgtatgaaaaaaatagaaacataaatgaagagacagaaaacctaaaaagaaagaaaaaaagagaatttggagctgacaaaaaaaataactgaaatgaatagtcactagagggattcaagagcaaatttgatcaagcagaaaaatcagctaacttgaagataggaccatagaaattattgtctgagaaacagaaagaaaaaagattgaaataaagtggacagagactatgagtcctgtgggacaccatcaaacagatcaacatatacattatgaaaatctcaggggggaagagaaggaggaagaggaagagagaatatttgaagaaatcatggctgaaaacttttcaaatataatgaaagatatggaaataaacatccgagaagttcaatagattctgagtagaataaactcaaagatactcaaagtgagatacattatgatcaaagtatcataatcccaaaacagataatgttgaaagtagctttagaggagtgacttaccacataaaaaggatctcaatactattatcagcaaatttctcatcagaaaccttggagcatttcccctatggataagaggaactaaggtgtagaaaaaaatagcaaaatggcagcagtaggtccctatttatcagtaattgcttttaatgtaaatgaattaaattctccaaccaaaaggtagagatcagcaaaatagagtttttaaaatgattcaactatatgccatctacaagagactcattttagatccagaaggcagtggactgatatattcaaacttctaaaagagcaaacaaagaaacaacatgtcaaccaagaactgtgtaactgatttaattgtatattttgaaataactaaaaaagtataattagatggtttgtaacaccaagaataagtgctttagggaatggataccccatttttcatgatgtaattattacatattgcatgcctgtatcaaaatatctcctgtaccccataaacatatacaactacaatgtaccaacaaaaattaaaaatgttctatagctggcaaaactatctttcaaaagcttaccactagaactgccctgcaagaaatgcttaagggagccctgcaggttgaaattaaagaacactaaataataagacataaagatctcaataaaggtgaatacatatgcaattataaaagctaatggtgtggtaactttgatgtatgattctactttttgttctctactctatttaagagacttacacatttaaaaaaattattagtgtcaaagttagtattataactttagtttgtaaattaacatttttttctacataatggtagagatgaatatattaaaatttattagtttatgtttcttaaaacacaatgtgtaaagatataattttataacatcgacaactaaaaaaggtagtgctgaagctgttaaaggtgcagaatttttatgttattaaaatgaaatggtataaattcaaattggtgtaacaactttaggatgttacatgtaatccccatggtaactacagaaaaataactaaagagtatactctaaaggaaatgagaaaggaatagaaatatttcactacaaaaaaattagctaaacagaaaaaaagatggtaatgcagaatatgaggaagaaaaaagctataaggcatagagtggtttcactttccatgggtttcactttccagggtttcactttccatggtttcagtttcccatagtgaactgcagttcaaaaatattaatcaatactcttgtgcttttgaaccagaattaagtaaaataagggttacttgaacctaagtactgcaatactgtgacaaataagctgctaaccaagatggttattaggtgactaatgacaatccaggtaaagatttcatcctgctcttcagaatgacatgcaatttaaaacttatgaattgtttatttttggacttttcaattatgtcacgatgcctacataattcacctcataaatctcatcacatagggattttgtcatctcacttcatcacaagaagaagaagggtgaggacagtgcaataaatattttgaggaagaaacaccacattcacataatttttattacagtagatagctataattgctccattttattactactgtatttttgttaatctctttctgtgcctaatttataaattaaactttatcttaggtggttatgtgtaggaaaaaccataatgtatatagggtttagtactatccatgattttaggcatccactttgggtctgggagcgtatcccctatgggtaaagggggactactatatagaaaaaaaatcaaaatgacagaaataagaccctactacttatcagtaattacttttaatgtaaatgaattaaaccttcccatcaaaagacagagattggcaaaatagatggaaaaaaacatgatccaactatatgctgtctacaacagactcactttagagaccaagatacaaataagttgaaaggttgaaaatggatattctatgcaaacggtaataaaaattcagaagaatggctaaactaatgtcagacaacatagactttaactttaaaagattatgagatgaacaaggacattacatattaataaaagattcaatatggcaaagagacaatataaatatgtttattttttgtgatggttaatactgagtgtcaatttgattggattgacgaatacgaagtattgatcctgggtgtgtctgtgagggtgttgccaacgaagattaccatttgagtcagtgggctgaggaaggcagacccacacttaatctagtgggtgcaatctaattagctgccagtgaatataaagcaggtagaaaaacatgaaaaggtgagactggcctggcctacatctttctaccatgctggatgcttcctgccattgaacaacggactccaagttcttcagttttggaagtcaaactggctctccttgctgttcagcctggagacagcccattgtgggaccttgtgattgtgtgagttaatacttaataaactccattccattagttctgtccctctagagaaacttgactaatacatttaataacagactaccaaaatacatgaggtaagaaatgactaaagaactaaagggagaaatacacagttttacaataatattcagagacttctatgccctactctcaataatggagagaaccaccagacagaattataactaaggaaacagtggacttgaacccataataaaccaactatatctaacatacatatgtggaacattctacccaataacaataggatacacattcttctcaggtacatgtaggacataagccaatcacaaaataacaaatactgtatgattccacttatatgaggtacattgagtagtcaaaatcatggggactgaaagcataatggaaattgccacaggctgggaggagaaaggaatggggagtaattgtttaatgaatatagaatttcagctttgcaaaacaaaaatagttttagagatgaatggtggtgatggttgcacaacaatatgaatgtacttaatatccccaaactttacacctaaaatagttgttactcaaaataataaaaagtaaatcaatctctctctctctctgtcacacacacacacacacatacacacacacacacacacacacacacacacagagagagagagagggcagacagcacaagccaaagcaggaaggaacaaagcactttctatacttgggaaataacaaaggaccggtaaggctagacggcatagatagtggagataagtctagaaagttgggtaaatgtcaaatctagaaaaataattgatgctatgttatggagtttttttttccattataatttaaagcaaatacatttttggattaaaaaaataaaatgaccttatttgctctatgtcttgggaaaaaataatatggaaatatagatgggagaggaaagagaattgagtaagatactttgtatttttggtattttgagaaaaactatttcatctatattatatataaattgttatattctaacaaaagttgatttttatgtactcatttatatctccttttaataatattgagtacaaaccatttccctaataagcatgtacccccaaccagaatattaagagaatacagggctttggagtgcccaagaaagacatcatgatttgatatgaaaataagccattgttttgaccatcagcaaatgatcttagcaagtacagattcagtggaaaatagaggcagaagccaaactgctgtgtgtggaagaataaatggtggttgaaggggtaaagacagcatcatttttcttcaggatgattaagagtgactgctagagcaggaggccagcttgagggtaaccagatcattttagcacaaatacaacctaatgtagccaagtcctgagagagcaagcaaattcattcaacagtcatccagcaagaatgtccctcatcactcctttggtgctgcactttcacacagtatatctgtaatgtgatcatgaaaagtaattaaagaaacagtctgcactgtcagtaaagcattacatctaagtgcttattcaatgttactgcctttagtcatcagtattttcaagaaagagtaaaatattgttcttttttctaaaaagtagtaaatcatctaaattaattttatcttattcttattttcctccaaatgagaacatgtgctactccccttatcagttaatgatttgctgaggtacataggataaaatagtctttaaaaaatcttttgtttatgttcattggtttccattttctacctctatcttcatcctcatattcagcctattttaaaatacttctttcctgagttccattcttccaggctttcactaatgtaaccctgtacattacactggatatattggggatttttgttggctggcataaacttaccacaagaaaattttgtttctacataatattttatgaaagtactaaaagctaccactatcatctcttctagggcctgtcatgggccaggaaaatgacaaattagctgccaaatctaatgaaaggttgattaaatataaagggaagaaaaattcaaccatcctcatacactgacaactgaggtttcttgcttttttctttccaaatgcccttccaatgaggggaagacaaaattaatatctcatccacgatttcagtctggcagaaaatgaacctcttttacaaacaggttgattattaattagcattcctaaaaggttgttcattttgctaatcttaaacactgaaattgaaattgctgcagatcttgacaggcacccactgaaagtcctcactccttaaataagagcttcatcagaaactatcaaatcttttagcacagatttgtcccgatttttaaggcatacttttcttggggctttaattttcacttgattctattttactatttttttgtattaattccctcacacattttagctattagaaagccagcatgaagcgacgtgtttttgtaaaaaatagatttgcctcaacaaatttttactcagataaagaaagtgaaaattagatttagtttgcaattttgaagtagagattttaaaggtcatttatgttgtgtgcatgtgtgtagtggttgtgtggtggtgtcatttcctttttttgtttgccagaaccattctgaaataaaaaatgagtgcaatatattagaaataaaaggtatctgctctctcataatctataattggtgtgctatttcttaatgtttgttccatagtagatgccatgggtaatcagccataattatggattaagattcatattttgcatataggtaccctattgttccagcagtatttgttgaaaatattggattagaagttttaatgtagcaacaaaattgctgctgtgacatgataaagtaaatgaactgaatatataagaatgtcttctaaaatcaagctttcaaagatggtgtctttgaaagaaatcaagagaaagggttgaagaaagagagtgacatatgtactaaagctatcaatgaatgagtgagagcagatagcaacaaaaaacgattagcatgaagctttgtcttgtggcatgagtttcaaaagatctggtgctttttgaaagaggacagaagactccccaaatggatctgtagaatattgtaatttctatcaaaatgcacacaaggatttttgtggacataggcaagttcctcctaaactttatgtagaaaagcacaggactagaatagctaaaacaaccttgaaaaataagaataaagtagaaggaattactctacctgctattaatgcttactatatggctacattgataaaaaagcaatgtggtattggtgaagaaattgacacatacatcagtgaaagagaatagaaaaagcagaacttgacccctacaaacatacccaaatttttgacaaaaatgtaaaagcaattcagtggaattatgctgagtggaaaaggccaatcccaaattttccataatatattattccatttatataacattttaaaatgacaaaattataggatgaagaatagattagtggttgccaggtttatggaagttggagggtgggaggtggctgttgctatagaagggtagcacaaggaatacttatgataaaactgttattttgactgtagtcatggtcaaagaatctacatgtgttataaaatgcatagaactaaacacacacacacacacacacacacacacacacacatctgttgaaatctgaataagctcagtggattgtatcagtgtcaaactcctgcttgtggtattgtactgtagttacgcaggatgttacctttgagtgaatggcacataggctcttcattgtatgatttcttacaactatgtgtgagtctatagttatctcaaaataaaatgttaaaaaaaagcaggagacagactataaatggtttgatcttcgtcttctattttttttagttcctattgaaaaaaacattgtaagctttcaaatactacatttggatgatagccttatgaaagattttgtggtttgatgcatgcaaattattgctttaaaaacatatgaccagttagtcaacataatcaacttatgttaccaatcagcactataattaagaaataagaacatgataccaaaataaactcaaaatagatcagagacctaaatgtaaaactttaagcaataaaatatctagaataaaataggaggaaatctttgtgaccttgtttaggaaaagataaaattcatagatcagacctcataaaaattaagaaattcaaaaaccagtactgagggaatgaaaagacaaaccatagatagggggacagtatgttcaaactacacatctgataaacaacttgtattcagaatgtatcaaaacatctcaaaactcagtgtacaaacaacccagaaaagtacttacagccagattagctttgcagcatatgtcccctgggccctgcaaccctgtagattgatgcagtgagagccaaatggagacatctcttacatgattgtcagattttacttgttgaatgaggaaaacagaaaaaaatacatttttgtgcttttaaagggaaaagaaaccaacttcccctcttcccttctgagagaggctccttggatatgtaatggaagaaatgcacactctagctctttgatatataaataattctctctaggaaccaaataagttcagtatctccaggtttcacaacatagagatgtctctaaagttctgggaccaatttcttttgaaatataaatacctgttttttgttgttgttgttgttgtttttttgttttgtttttctttttttgagatggagtcttgctctgtcacccaggccggagtgcagtggtgcaatctccgctcactgcaacctccacctcccgggttcaagaaattctcctgcctcagtctcctgagtacctgggattagaggtgctcaccactgctcctggctaatttttgtatttttagtagagacagggtttcaccatgttggccatgctggtctctaactcctgacctcgtgatctgcctgcctcggcctcccaaagtgctggattacaggtgtcagccaccacgcctggcctaatctaaatatttctaagagaagtgaaacaaacattatttatcttatactatacatatttccatgtttcatggacctgcagctttgaaacatgggaataaatccaggtttattttctcacagtgacattatgctaaaattagaatatttgttcctcaatttcagctgagatccaaagatagaacataccaatttgttctagtgtcaactgtattgaactaggagctatgttctccataatctccttaatctgtatacttccagcttagagttggataagagaggaaatcccatattaggaggttaaagggaatcaggggcctttactctcagaaagatctaagtttgagagtcactgacaactacagaggcgctcggcttttcctcactttcctctactccaccagctcttcttcccaactgttgaccttgaggaccaacagcggttccaagcctgcccccagttgcagataacagaggccacactgagacatcttccccatagatccctccacaacctcccttatacagtccctctaaggaagctcaacttgcttgtctactcagatgtcactgccaactcctagtggtcctctgctccagtgcttcaagatgactgtttaatgactttatctgcaatactccaaaacttccctctgaaaattcacctccccagcaattcctactcttgtctaagacaggaacgggcaaagtatctacagtcccattgcttattttttaaaagaaaattttattaaaacgattattcccatttgtttctgtatcatctgtggctgctttctgctatacaacagaattgagtagttgtgacagaagccttcgggcctgcaaacccaaaatatttactgctggctctttacagaaaaggtgttgatgtctgctgtaatgtataattcctataaaaattccatattccattatgtttctcccttcctgactgaaccttcactgatgttctcacttaaataggacatgtaaagaagatggctaataattgatttaagaattgttttttttttttttgagactgaggtcttgctctgtcacccaggctggaatgcagtggcatggtcaagctcactgcagcctcaattgcccaggctcaagcgattctcccacctcagcctcctaagtagctaggactacagatgcatgccaccacacctggctaattttttctatttttttgtggagatggggatcttgctatgttgcctaagcttgtcttgagcctctgggctcaagcagtcctcccgccttggcctccagaaatgctaggattacaggcatgagccaccacactcagcctgatttaataactgttagttcatctccaaataggcacccctaaaaagttttacagaggtttagagtccagtgaacaattggagagggaatttccttgaaaaacattttgttgaacagctgtggcattctcccttgcccacagtttttccatcccactaccatattcttacacattttataggcaagacacagggatattctaagatcaagccttgtcagggagtgggatgagggttggagtagctttaagtagaccacataagtttgatactagagacttgtaactgcagacttaactggcaagagactggctatggtgcctatggcagcaaagtacataattgtgtttggaaagtaactgtattcccatcacaacttcaaaaaggatgcatgtctcccagataatacatatggaacctgatgtagagacatcagcataagactaatttagaaagaaccactttcaagacaacttccttcaaggaataggaggagctcagcaaaaagactggaattgttccattcaatgaagaagccaaggggctaggtatatcctctctgagtctctctttaattcattccaatcaggctgtctgcctacctgctctagcaaagataatcttttctagttcatctggaatatctattttgccaaattcaatgactactctttggtcctcattttactcaacttgtttttcttaaactgacattttattttatttatacactatataatttgttatagatttttattgtttatatttatggtgtacattgatggtttgatatatatgtattgtggaatgattacatcaggctgattaatatatctatcacctcatataaatctgcatctttttttgtgatgagaacatttagaatctactatcttagcattcttaagtatacgctacattattattaactgtaattacctcgatgtacaatagatatccaggcttaatctcctaactaactgaaaccttgtatcctttgatcaacatctccccattccacctgcccaccccagcccccactccctggtagcccctattttccaatctacctctctaagttagacttctttatattccacatataattgctatcatgcagcacatttctttctgtacccagcttatttaacttaacataatgtcctttaggttcatctgcgttgttgcaaataacaggattttctttaaaaaaacaaaacctgaatagtattccactgtttgtatgtgtatacattcatatgtatatgtgtgtgtgtgtataaacaacagataaattgataaaaagtgacatatgtatcacacttgaataatggctactgtgaataatgctccaatgaacacagaagtccagttatctcttcgagatactgatttaatttcctttgactctatacccataagtggaatttctgaatcatatggtcattctatttttcattttttgagaactctccatactgttttctataatggttgtattaatttatatttctaccaacagcatacaagggttctcttttgtccacatccttccaacacttgttatattttgtctttttgataatagcccttctgatagatgtgaagtagtatttcattgtagttttaatttgaatttccctgatgattactggtgtttggcagtttttcagtaccttagcagcatttgagtatttgccatcagtgacaactgtctcctttttgaaataactttattggctttaggaacaccatgttctcctggttttgttgtacctcactttctgttctcaatttcttttgctggattcacttcctctgcctaaactctaaatattgcaggactctgagcttgactctgggcccctctcttctcatcgaccttcttttcataggtgatgttttctgattccacagtttaaaataccatcaatatgctaataattcccaaattgatctcattatcttctatctctcctctaagctctcagctcataaaaccaagcactttaagtctccactaggctctctaaaaggcatcttatatttagtacggccaaaacataacaggctttccaacataggtaaatgttactgcattccattcagttctcaagtcaaagctagagcgtgtttgcttgctctcttcctttctactcaagtcagatccaatacattgtcaaagtcaacactaccaccaccaaagatcacccatccatccttttctctatatttataatgctatcacctaacctaagacagcaacatcttccatgtaaactactagaatcacttcttaacgactttcctgcttctattcttgctcctctcctctgcccaaaccattctatataacaatcagaaacatcttttaaaaatgtaaagcaggtaattttctccccagtttgaaacacttcatattaggaaaaaattcatttcctttaccatggcttgtaaaaatttacttaaaactgatttgatatttgcagtctcttatctcaactccacaaaagaatagaaaacagtatgttgtagctgggaaactgcaaaacattaatatggctgaggataaaggtagatatgtgaaactttggaaggtgatgagactgaaaatatagaaaggatgaaattgaaaaagacttaggaacttagaagttgagactttcctcaaggaatttgaacaataaaatgactatatcaaaaattacacatttttaagaccaactggcaataaactaactttggtttatcaatgataaacagtgcctcagattaatcattttagcagatgttttaggtgacccactcattctttcagcccacgtctgatttcagcaacagctgtggtgaacaatttctgcaaacaatgtcaacttttcatctcaaaagaggcccactctcagcgtttgtgcttcagtgctttcctgaaagcagcaggtctctcaacctggaatgagggacactgaatgccttaagggtgtctggagtcagtagataaatgccctggccacaggtcatgatttccacatatttactcagagagctcttttcgcccacagcactaggcagctggaaaactggactttattgagttttcttctttcactttctcatttaccctgttcactcactcttgcttcctgtaattgcctcccaaatatggcatccaagtccttgttttagactctgcattaggtggaatccaaaaattacagacaatcatgctgttctttattcgagaactattagttgagaataatgtgcttaaaaaaaaagtcattaagacatttcataaaataatggtaaatcttctaagagtaaaactagaaatgtatgggatgaaaagacagataccaacaaatgttaatactagttagtactattttccacattcttcagcccatattagtttttttggtagctatttcaactgacatgaggtggctctcagctgaacatggagttattgtttgctctcagtttcgtatcttatataatagcagtgtcaaaatcctgtgaaatctgagcaatcttcagctgtgaaggacaagggaagaaagtcttttgagacaaagggctcgtaacttggattcttgttttttatatgtatattttgcatttcaagcttcagccacaagcttttttttccccagcatatattttatgttttttctctttctcttacatgccttaatctacttcttcttttgttcaactaaatgtatgccatgttgagatcctcatagcataaaacctttcatttcagagttgtttctgcataattgcctaggcaaatggtattctaccattaaattgtttcactttttattgacatcattactgattaaggaggacaactaaattatgttaggttcaattaagtaggctgatgggacaatccagatgtaaagaaatgctagttatgtaatttttaaaaaagcctctgaaccctcctacactgactacatttccatcccactcttcagcacatgatttttttacagcaaactaaagtttttaaatgaaactaatggttaaaaattaaattatctttttggtaagtcctaaaagtacaagtttagtgtatatacatattgtcacagcaagccaaaatctaagaagaaacaatggagggaaaacatggatttctttgtcttataaactggaagagagcaggtgctttgtctgatttgcttgatacataccaagaagatgctcaataatgatcactcgttatcaatgtgccattggttatcacatcacaaggttattatgagcattctttatattaaataatggatagaagattactaaataccaagcacattgtaagtgtaaaataaatgtgttttccttggtatgccctattctcatttgttgattaatgcagcaatcattgctttatattgaaggttgaaaataaatttaaataaatagtctgtgaactagcgaagtccataaaaaaaggtttagatccttgttgttttgcagtgtggtaatggtttcagctttcttaagctctcctaagtaggtagcagtcatcttacgtagatagcagtctgatggaccagaacatggatatcactaataactctgtatttctgtctcactgtaagcaggctacgttattttcagctatttttgccacctatagtgctctatttagaacctcttagaatgtaagctagcaaactgacaattaaaaattaggtcttaattaagtaagggtcttgtgaaaatttagttattaaatatgtaatttatatgtttattctgattttcttgatgattataaggaaataactatatgtctattcacttcagtatttttaactagttaacagagaaaaaagttgaaattaatgatttacattagttagttctgtttagtatccagaatactttaaaatctcattaaccatattgtatgctatccttcaataatggatccccttaaataaaaaatattttggaacagttgattgctaatgcagaataaatagtaaaacaattgttggtagagattgagctccatataaatgtaagatgacaccatgtttaataaagagttatgcatcccatgggaacacaaaaatatatttcctagattactgaactgttgataaactatgatatgcacatttaataataataaagttagtaagtattttgtcaagtctgtaatatctgcataaacattctgacagagaaattgggagagaaaaagaaaataaagcctttattttcacatttagcattagaagagtggtagactccaccagaaataccaacttgggttgaaagagaccattttgcgctaagcttatattgatgatgtacgtattttggtgtgaggattttgccttgaaggtacatgccagctcgtaggagttcgatttaacattcacctctaagcactgaaaaatctgggttatggtcaacgcagcagcttgctacaaataaaattaagactcacctgagattctatgaattgctttactaaaagcctggttgtttaacattgttgctaaagttctgggaagaaaatccaaacacaacatataaaaataaatttccatggctcctactgtttcctttggaaaggcagataatacaattcttattgccttttatttacagatattgttacaggaaagatagatttgactaaaaatgtcatctaggaaaattttaaccaaaattagaaattttgctagtgatctgggttgctaagaatctaagcattaatacatgatggtcttgtgtaggtaatcttcttcagttgtgatggatgagagcccctgtataggatggggaaggaaagaattcagagaaataagctaatatctgagtaataaatttaacagaaatttgagaatgtccctagataaggctgaagataaaggagaactttgctgctttttagaaaggagtggtcaggactgatggaagaagggagaaaatggaagggactggagagtgtgagaacggttcccacaggctgagattaaggaaattaacttttcccttgaagaaaacatttttttcatggtagcaatgacagaagaactttgtgaaaaatgttatctaaagtccaatttaaggctgtttcatttctggttctgctgcatttttctggcatcatccccccaaaaatagccatgcaaaagtgtaccttgaaaattaaatgggaggtcaagaaagccaaagaggggagaatttagtgagagccagaacctgggaccagaagagagaccaaatacctcttttcactacttaatttcctcaaattccgagagagagagaactggatttatcacagtccactgggtaggataatagcgacttaaaatagacattaacaaaaaggcttatctcagaagtatagataaaagtaaagtacacatttttttgtatgattattagttaggtaatgaatgggtgaatttcttgggctgcctcactaatttgtgaactatgttgcgtatttatttaactctatatttctaccacattcttcttttctttcctgagtgtctctaacatattgatgaaaatgtgtaggttttgacctttaagggaagatgaattttaaggagcagattttaaaaaaattattcaaagtaagtaatatagcttacattttaaagatagtttatagaatatacatatatatatagacatatgtagagagactatatgaaggcatacatacttctatgtgtatgtttgcttttgtagatttgaagaattgtatttcttttattttttaatttataaagaaaggaggcttaactgactcacagctccacatagctagggaggcttcaggaaacttaccaatagtggcagaaggcaaaggggaagcaacacgtcttacatggcagcaggagagagagagagtaaaggagggagtgccacttttaaaaccatcagatttcccaagaatacactcattatcacaagaacagcttgggggaaactacccccatgatccaatcaccttccaccaggcccctcccttgacatgtggggaaaacaattcttttttttttcaataggttttgggggaacacgtggtatttggttacatgaataagttcttcagtggtaatttctgagattttggtgcactcatcacttgagcagcctacattgtacccagcgtgtagtcttttatccctcaaccctctcccaccctttccactgagtcctcaaaatccattgtatcattcttatgccgttatgtcctcatagcttagctcccacttatgagtgagaacataacgatgtttggttttccatttctgagttacttcacttaaaataatggttttcaatcttatccaggttgctgcaaatatcattatgttgttcctttttatggtgagtagtattctatggtatatatgtaccacattttctttatccaattgttgattgatgggcatttggctggttccatatttttgcaattgcgagttgtactgctataaacgtctgtgtgtatcttttccatataatggcttattttcctctgggaagatacccagtagtgggattgctggatcaaatggtatatctacttttagttcttaaaggaatcttcacactcttttccatagtggttgtactaggttacattcccaccaacagtgttaaagtgttcccttttcatcacattcttgcccacatctattattttttgatattttgattatggccattttggcaggagtaagatggtatcatattgtggttttgatttgcatttctctgataattagtgatgttgagcattttttcatttgtttgttggccatttgtatatcttcttttgagagttgtctattcatgtccttagcccactttatgatgggatttttttcttactgatttgtttgagttccttgtagattctggatattagtcccttgtcagatgcatagattacaaatattttctcccactctttgtgttacctgtctactctgctgattatttctttggctgtgcagaagtttttttactttaattaagtcctatctatttatctttgtttttgttgcatttgcttttgggttcttggccatgaagtctttgaataagccaaggtctagaagggtttttttctaatgttatcttctagaatttttatggtttcaggtttcagatttaagtctttgatctatcttgatttgatttttgtataaggtgagagatgaggatccagtttcattcttctacatgtggcttgccaattatcccagcaccatttgttgaatagggtgtcctttctccactcttatgtttttgtttgctttgtcgaagaccagttggctttaagtatgtggctttatttcagagtccactattctgttccattggtctattgcctgtctttatacaagtaccatgctgttgtggtgactatggccttatagcatagtttgaagtcaggtaatgtgatgcctccagatttattctttttgcttcatcttgctttggctatgcagggtcttttttggttccatatgagttttaggatggtgttttctagttctgtgaagattgatgatggtattttgatgtgaattgcattgaatttatagattgcttttggtagtattgtcatttttacagtactgattctacccatccatgagcgtgagatgtgtttttattagtttgtgtcatctattatttctttcagcagtgttttatagttttccttgtagagatctctcacccctctggttatgtatattcctaagtattttatttcctttctctgcagcaattgtaaaagtgattgaattcttgatttgattctcagcttggtcactgttggtgtttagcagtgctactgatttgagtacattgattttgtattctgaaactttactgaattcatttatgagatttagaagctttatggatgaatctttacggttttttaggtacacgatcatatcatcagtgaacagcagcagttttactttctctttaccaatttggatgccttttatttctttctgattgctctggctaggacttccagtactatgtgaaatagaagtggtgaaagtgggcatccttgtcttgtttcagttctcagaggaaatgctttcaacttttccccattcagcataatgttggctgtgggtttgtcatagatagcttttattaccttaattatctgccagttttgctgggggttttaatcataaacgttaatctattttaatcataacgggatgctggattttgtcaaatgttcttctgcatctattgagatgatcatataatttttgtttttacttctcttgatgtggtgtattacatttatggacttgtgtatgttcaaccagctctgcatccctggtctgaaacccacttgatcaaggcgtattatctttttgatatgctgttgaatttagttagctagtatttcgttgaggatttttgcatgtgtgttcatcagggacattagtgtgtagttttctttttgtattattctttcctggttttggtattagggtgaactgcttcatagaacgatttagggaggattccctctttctctatctcttggaatagtgtcaataggattggtactaattcttcttttaatgtctgatagaattcagctgtgaatccatctggtcctgcactttttatttgttggcaatttttaaatcaccaatttaccactgctcactgcttgttattagtctgttcagtgtttctacttcttctggtttaatctaggagggttgtacatatccaagaatttatccatctcctctaggttttctagtgtatgtgtgaaaaggcattcatcgtagccttgagtaaacttttgtatttctgtagtgtcggttgtaatatatcctgttttgtttttaattgagtttatttggactttctgtcttcttttcttggttagtctcactaatgttctatcaattttatttaccttttcaaagaatcagctgtttgtttcatttatgttttgtattttttgttgttgtttctatttcatttagttttgctctgatcatgtttgtttcttttcttctgctgggtttggttttggtttgtttttgtttctctagctccttgaggtgtgaccttagattgtctatttgtgctctttctgactttttgatggaggcatttaatggtatgaactttccttttaacactgtttttgctatatcccagatattctgatagtttatatcactattatcattcaattcaaataatttttaaatttccctcttgattttattgctgactcagtgaccattcaggagcaggtcatttaattttcatgtatttgcgtggttttgtgggttccttttggagtggatttccaattgtattccactatggtctgcgagagtacttgatataatctcaattttcttaaaattgttgatacttattttgtggcctatcatatggtctatcatggagaaggttccatttgctgatgaatagaatgtatattctgtggttcttgggtagaaggttctgtaaatatctattaagtccatttgttcttgggtaccatttaagtccattgtttctttgttgactttctgtcttgatgacctgtctagtcctgtcagtggcatattgaagtctcccactattactgtgttgctgtctatctcatttcttaggtttaatagtaattgttttataaatttgggagctccagtgttagatgcatatgtattttggattgtgatattttcctgttagactagtcctcttatcatcgtatattgtccttctttgtctttttaaactgccgttgctttaaagtttgttttgtctggtataggaatagttactcctgctcattttggtgttcatttacatggaatatctttttatacccctttaccttaagtttatatgggtccttatgtgccaggtgagtctcttgaagatagcagatacttggttggtgaattcttattcattttgccattttttgtctttcaagtggaatatttaggccatttacattcaacattagtattgaaatgtgagactctagtcaattcattgtgccatttgttgcttgaataccttcttttcatcatattgttttacagttcctgtgagttttatgcttcaaggaggttctattttggtatattttgaggattgtttcaagatggagagctccttttaacattttttatagttcttgtttggtagtggtaaattctctcagcattgtttatctgaaaaagaatgtatcatttcctcatttatgaagctcagtttaatggatacaaaattcttggctgaaaattgttttgtttaagggggctaaaaataggaccccaacccttttagcttgcagggtttctgctgagaagtctgctgttaatcagataggttttcctttatagtttaccttatgcttttgcctcacagctcttaagattctttatttcattctgactttagataacctgatgactaggtggtgaagcaatgacctttttgcaatgaatttggcaggtgttctttgagcttcttgtatttggatgtctagatctctagcaaggccaggtaagtttttcttgattatttcctcaaatatgttttccaaatgtttagatttctcttcttcctcaggaacaccaattattcttaggtttggtcatttaatgtaatcataaacttcttggaggctttgtttatttttttaaattcttttttctttgtctttgatggattgggttaattcaaaagcctggtgtttgagctctgaatttctttcttctatttgtttgattctattgctgagactttccagtgcattttgccatttctctaagtctgtacttgatttccagatgttgtgattgttttttattcatgctattttactggagatttttccattcacatcctgtatcattttttttatttctttaagttggacttcacctttctttggtgcctcttggattggcttaatagttgaccttctgaattctttttttttttttttgttaattcagagagttcatcttggtttggatccattgctggtaagctagtatattttgggggtgataaccttgttttgtcatattatgagaattgtttttctggttccttctcatttgggcagactatgttagagggcagatcagggactcaagggctgctgttcagattcttttgtcccattgggtacttccttgatttggtgctctccccctttccctagggatggggctttctgagagccaaactgcagtgattgttatttcttttctggatctagccactcagctgagctgccaggctccacctggtgcttgagagtgtttccaaagagtcttgtgatgtgatttgtcttcaggtctctcagctgtgtatactaacacctcctccggtggaggcggcaggggagtgaagtggactccatgagagttcttggttgtatttttgctaagtactgctgattttgtgttcgttggcctcaagccaggaggtggtgctttcaagagcacatcagctgcagtagtatagggaggatacaagcttggcctaggatcaggcggtgtgtggggccatggagctcccaggagactatgtcctttgtcttcagctaccagggcaggtagagaaagacaatcagtggagggcagggttaggagctcagactctccttgagtggggcttgctgcagctgctgtgggggatgagggtgtggttcccagagggattatggctgcctctgctgcctcacacaggttgccagggaagtaggggaaagccggcaacctcaggcctcacccagctcctatgcagcctgcagcctgaaaggctgatctcactccctctgtgcccctgacaacaggactgagtttatttccagggctgagaacttaccccaggttacaagcctcctagctgagaaagaaaagggactcagctcctctgctgccccacagagcctgcagcaacaatccatccacttcaaaaagtctgtggaagttctcagctttcctggtatgttcctgccgtggttcttggagaaaaggttcacaatttgggtctccacacactgtcctgcccatccaagtgggagctgcaagttagtcctgcctcctatctgccgttttccagaactgtatttctttacccactcatttatttgctgtttcctatattttgtacaaaaatgactaaaaattataactaataaaggttattttcctacatcttccctcttccaaggctttttcattgttttcgttaatgaattttttttgaaaaaagaaatgaatattatgttaactataatattaattttcagaaggatagtaagaagacgagtcccaaatcccaatcctcagaaataaacactgttaacacttgatggacataattacagatatgtctgctggtgtgctggaactggcttgtactggcttctgagaactaattgtgtgcatcttgtcccagctctgtacccagggacattacattagtagactgaaatcagtcatgatgggagtattaacaccacggaaatagactacactcagaggctctttttgtgttgctgttttttgttgttgttttgaaagccatttactaaagatttgcaagcccatacatcactgaatatatcactatgaacagatatagaaagacagctaaacattttctataaggagacagacaaaaattacctcatggtctacattataatatttaattaaatgtattcaatttaaaaatatttttaaattttagaagaaagagaaattgaagtgaaattaaaggaattgctaaattctggctggtggggagaggcactattatgggccctatataagccccagtactgctcactcttatcatttagggagggagaggacagttcactttctgtgcagctctcacctttccaggagtctgtcctgaagattttagctgccttggtgttcctggactttcaactgtctctttaactcagaaagttcacggggcttagctcattctctgctccgtagcctcaaaactctctcaaggcagtaagctaggcaggcagccatggggctctccttatttgttttccaactctcagtcatgagtgtcatttctacctgatgtctagtgttttagaaataattgtttcaatatattttgttcattatttgtttgtttcaggtgagagagggaatccagtttctgatatcccatgtggatagaagttctaaggatatgtgtgcaaatataaagtcttttttcaaattatgttgatactgtggatagtttaacattccttccaataattccctacctttacaaaggtctgataaatgccagcaaaatattagatggtgaaaccttgataaaatgaacggtaccaggtaaatattggtaattttaaaaaagatgaataggccatgacatctgttttgaacctaaagctgaatatcagaatgaatcttctgcttttgtattagcatccatggactgtcaagcctttacattttattagggtaacaataatcaacactgtatttataacatgcattcatgatcaaacatcatatttaataaatgctgttgaattaatgtagttttgtttagaaatgcagcctgaataaagtattacaagacaaacataaaattacatttttaatgtgcagttttgataactgtatattgttaaatatatatatacaattttgaggagaacacctatctcaattaaaattcttttcgagcatctacttttaatattgtatgaaggaagctacatcagtatcaaccaagcctcttttctttagaaatgtatgattttaatgaaatttaccaacctggggattgtgacaactaattaacatcttacttatatacactagatatttctgttcactcagttgtatattcatgtattcaacaaattgttttatacagatgctccttgacttacaatggagttacgtcacaatgaaatcatcaaaagtctaaaatatcataagtcaaaaatttaataccctgataagctcattgtaaaataaaaaaatttaagtaaaaccatcataaattgaggactgtctatgtaatacaaatattctgccataaataaaatattgttaaaagtttaagttgttctatagacaatttagaatgtaaaataatgcttataataataataaatgttctatcaggtattatagaatactagatggtcctacattttagttttctagataattgaagttttccctaaatagaatcaataatttccaaaagggttacctacttaccacatatctttctaaagtacattccatgtattttgttctttctacatagggcaaacttttaaaatttatagtttcactaataattcagtgtcaacacttgcattatcaaataccgtttttgtggctataatatattattgtctttagaaaatgtgtgaaattgatgttccctacatgaaattttccaagactttatgcctttttaaatatgtcagtgttttatagttttcctctgtctttctttattcaggcttttatatggcccttttctagttctgtagtgattctgtcttcatcagcttttcctctctcaattctaatctattgtgaccagctcataaggtaaccaagctaattagaataatgagtttaataaaattggtctgtgagtaatgccttaaaatatggactttatagtaaaagcttcactgtagtcttttaactactggagacttttccttgttttcttcctgcttctggattcttgaattgaaattgttctttgaagttttacatttaaactgcactttcacatctagaagaaaaatcacatctgtaaactacacccaagtccagggtgataaagccttaatctgaaagagaccaccatacttctgagatgtatctaataaatgtttagcttttcaagaagattgtgcagaatatacaacccccaaaatacacaagtgggaagagtgttttcaaattacctcatttgttggttgttgatgtaatttaatgaactgcaatatacccttcagattaggctcaaataacttaccttcttggaagcaatttctgacctttcagatagagctgatagattcttcctttatattcttcctacaccacaaattttttctctatcttaatcccattatatacatatttgtttacatacaagtcttgctttttagattgaaagtttccagatgacaagtagagtaacttaaagaatctctaagccaagcacagtgccaacataaagtaagagctcaatgaatgtgcattgaatagatggatattccctttagcaattatggaaacaacatgatattttatgaaatctatgggattaaacaaatagcatataacgtactgtgttatgtgactaaggtcacaaagatgagtaagatataagcccttactgtcaaaaactagacatatgtaaaaagagataaaatggtacacaaataaccgtggagctgtattagttgagataggccaagatatgctctagttcaagttggtccaacctgtggcccatggactgcatgtggcccaggatagctttgaatatgacccaacacaaatttgtgaactttcccaaaatattatgagttttttttgtcattttttttctttttcagctcattagctatcattagtgttagtgtagtttatgtgtggcctaggacaattcttcttcttccagtgtggtctagggaagccaaaagattgggcacccctgctctagtgagtaatgagtaaaccctcaaatctttgtggcttacaacaatagaattttctttctgcttcatccaagttggaggtgggctagaaactttactcactcctctccgaaccatgacacagggatctgggcttcttctgtcatgtatctgggccaactctgagtctttgcctccaagaaatggatgggagagacagacagagggaaatgggcaattacaatataccgttccatgaggagccagtttgaaatagacatgtgtcacttcttgtcacatttgtttggccagaacttgctctattactctgtattggttcaaggggctcagaaatatattcttcctgtctgcctaggaggagaaaaacaaatggtctgattagcactgtggtatgcagcatacagtattgcctctagctcagttgccaagtgcaagtatgaagtcaatatgtacaggcaacttataaaggaacaatttacttatataatacttcaacttatttcttatcactatactccaagatgttttcctgacgtgtcattaaattacaagtataaaaacctctctttagacaagaaagcataacaatcacatgcatcttagcactgctgagcttttatttcattcacctcctgataaattgctgtttgtaaatattgtgttaatgtctgttgagaccagaacaatggatctggtaaaaaattgattcaattaagagataaagaatgaagtttaccattattttacctttttggtgacaccaatagaaccatgtatttcgtcattcttgcattgctataaaggaatacttgacactgggtaatttataaagaaaaaagatttaattggctcagggttctgcaggctgtacaagcattgcactggcatctgcttggcttccagggaggccttggggagtttttactcatggtggaaggcaaagctagagcaggcatatcacatggtgagaccaggagcaagagagagggggaggaggtgccacaagcttttgaacagctcgatctcatgtgaactcactattgtgaggaaagcaccaagccatgaagaatccaccctgatgaccccaacaccgcccatcagtctccacctccaacaccgggaattacatttcaacatgatatttcaaaggaacatccaaagcatatcaaaccatttcttaaaaaaaacttggcattttattactttactatggtttagtggtataattctttatgctactatccctagagaacagacatatgtgctgtgtatgtgtcacacacacacagaaacacacaaggggcccatttccacacatatacataaatatcagtggtcttggcattgacccaatgtctgaatttgtaccttcagacatatgggaatattttcatctctaaaaatcattttgtacattaatgtttaaattatagcttcatatttgatataaaaattctgacttctaacttaatatgtggttattatgctgctactcagtgaatgtattttcaacatttaaacattttgtccttcaaattattaatcatttttcattctaaagatgactataagaagtacaagaaaaacattatagaataaaagtacgtatgatttggtctccatattttacaaatgaagaaatggcttactactggctaagacaagaactcaagaattgtaaaaaaaactgtataggttttggattcagacacacctggattcaaattttggctctgttgcttaatttctgtgtgaatatgtataagctacttaatcttcctaactttcagtctttttatttataaaataggtgttacagtacctgaatttcagagttgctgtgattagatgaaattagataattagatgaaagaagaagaaagaatgtagctgtataaaattcttgttatcagcagcaaatttctgactctctgataataataattggatattcttatactactactactaatactagtactattatcagtttctttctaaagtccttaaggacttatcagagcaacttcaaactaaaatagaatttaaaagtgtacttttctttttcatttgaatactattattaacaggttgagttttggcaaatagtttccctgttaatataatttcttgaatttgacaagtataacaaaatatgttatctgaacacagtggtaataacataataattgaacacatcacagagcagagaattaaaatgatgtagacttcagaaatttcttgtattgttagaaaaacgaataaatggcaagaaaaggatgatttattgtatggctgttatctttttaaatcatcttggtagaaggtataggaagtatctttctatgcattttccatcatcatgggttcatattgagagaaatcattctattttttttgtcaatgatagtgtctcattgctaaaacaactgcttgaaaacagttttcaaaaactagatttcactttaaagaaaaaataaaaatctacactatttccacttatttacattttaaataataaaattacgttaagaaacaaaacaaaataaatacgtttgccaaaatctatctgtctttgttcttcacatcacttcattttattttaacaaatttactgaggtaattcacatgccatacaattctcctatttatgcacattacttcttgaataagatattcctatgcctatccaatctaagaatcccaagaaaaatcaaaataaacatatcgatattgaatatcaactctgtaaaaacgatcagaatagactagaataggtgctggggtgagacaattatttatatgttttttctctcaaggtattaactttcaaattagaagaattggacataggtacattaataaaatatttaaataaaatattaaaatatgttatatataatagaagagatactataacatactcaatgactaataataaaataggggtcataaaataaaagtgatttaggaatttcaaggaagaatatatattttacactatattagttgataaaaatttcctagatgagataaaatttaagttaggagttcagagaaggccagaagagaaggggagttttcctgggtaaaggggaaagaaggggtcaaaacatcaacaaaagcaaaggagtagaaaaccataagactccctcaaggagcaatatgtgaaaaataatcagctggaacagagtgttgcctttgaggagaattataatgtattctccagctgggactcatgggcaaggttgttagccagaagatatacctaagcccatccaatctaagaatccaaagaaaaatcaaaataaacatacaaatattgaatatcaactctgtaaaaaaggttagaatagactagaataggtgctccaaaaagccacaggatatgcagcatagcttatcatatggaaataccatatttccttgggactaattaattgaagatgtgatttttgtttttgaaaactcatataaattggaattttatgtcattttcaagtgtttcagctgctctccttaaaaatcatgagtatgggtttattctccttaatcatttcagctttttagtggaaaaagctgattatcaagaattaaaaaagacaagattacgagatcaattgggtcctgttggtggaaaaacttaaatgtcagattaaagagcttggactttgtgttagaagtaaggagccttagaagaatgctaaactgtgggaaagtatactaaaaaatctttcaataaattaatatggcaacttaatatacaggatgtatgaatgaggaaattattattattattatactttaagttttagggtacgtatgcacaacatgcaggtttgttacatatgtatacatgtgccatgttggtgtgctgcacccattaactcgtcatttacattaggtatatctcctaatgctatccctcccccctccccccacccacaacagtccccggtgtgtgatgttccccttcctgtgtccatgtgttctcattgttcaattcccacctatgagtgagaatatgcggtgtttgtttttttgtccttgcgatagtttgctgagaatgatggtttccagcttcatccatgtccctacaaaggacatgaactcatttttatggctgcatagtattccatggtgtatatgtgccacattttcttaatccagtctatcattgttggacatttggcttggttccaagtctttgctattgtgaatagtgccgcaggaaacatacgtatgcatttgtctttatagcagcatgatttataatcctttgggtatatacccagtaatgggattgctgggtcaagtggtatttctagttctagatccctgaggaatcgccacactgagttccacaatggttgaactagtttacagtcccaccaacagcgtcaaagtgttcctatttctccacatcctctccagcacctgttgtttcctgacttttttatgattgccattctaactggtgtgagatgatatctcattgtggttttgatttgcattttgaatgaggaaatattataggctgaaaccagcttagaatgtgcaaacacaaatgatttattaaggcagttgcatcattttcagagccaattctattatgtgatttataaaaattgtttaaggtctgctacagtttgaatgtctcccacagaatttatatgttggaaacttaatccccaatgtgacagcattggcaggaggagccaaatgggaggtgtttaggtcttgagggcaggatataaatggctgtcaaaagaggatttgctctcttgtgcactttgacctcctgccttgtgatgacacgggaagaaggcccttaccagttgccaatgccttgatcttggactttccagcctccagaactctgagggaataaatttctttttttttatattttactcggtttcaggcattttgttatagcagcacaaacgaattaagccaaggcccattgtccttgactaattcttgaagattagagggctcacttcattggagtccaatattgctaatttaaaatctaataattgtatatcatcaaaaaaaatctgtgaaggcaataaactttcctttatggaaataaaaaagacactaaattagttatgccatatcatttcaaagttgaactaatagaaaatgttacccattaatgatttatgttgtctttatcagaaacaaaaaatgccttccaaatacattttatcaaaaatcatttaagaaatacatctcgttttatataagaaattaaagtgagtctaatcccaaactattataaataacaagtgttgatctcctcctcagtcctccaagaaacagaaccggcaaatttctgaaattgttctaaaaaaatcagtgattatttcaaaagctggtaacagtttttgaagattagcattcttggtggaatatttaatgagcagtttagctgtagttccctagcaaaatgaagaagtccagaaattgtgaaaaacatatggaggcaaatggcaaggttcaccatcccctgcccagtgggatctcagctacatccatgtgatccctcagccatatttaggtctttcgatttctgcagatgaaagaacattctttcacaagaaatagagaagctaccatgataataaaagctctttgggtgccccatcagatgtaagctctccttgatgatgatgtcgattatcatcctgttatttttggcatttattcattttctctcaggcatgggactttgcctcataataagtaggagggcctcaatttcttgaagctgccagagcaaccatattccaactatcatttttttcacaaatgcttacaagataatgtatagtgaacttcctggttgagaacgtgaaatgtttttgtacatttctgaagaatggcaaactacctagcttaaataccccgtgcctaatttccactaacattgttcaagagtcaaacctcataaaccccaaagcatatatagctaagggtggaataaaggtgggctcagaatgcttaaagcccgttatgtcccatgttataaaggactcagaactaacttctacccctggtactttccttatgcttctcttaatgaggtctttccaaaagatataggtgtcattaactcctggaaatcaattcttccttcaatattgttgcaggcattaaaccagaagtgactattaatatcaaaggaatatttaagttacaggagaattagtatgaaatatacattcatatacattaatatgaagtatacactcatagggtattgttaggtgccataggaaattgagaaacctgttatctttccacaatccaaatatttaagaattaactatagaaacatatgtacataaagaattgtaaacaacagtatgacaaattttctatcaaattttaaaaatgtaggaagtaacgacaatctaagtggtataatgcatatttaatattttctagggatgtatgtatgcttgatatatttaccaactttgatttttcaatgtaatatatacactttgagaagtaaatttaggtgttcataaattaaggagaaagtagccaataaaaatgaagtgtcagtttcatttgaatagggatttttaaatgaataatttacaatatgtagagagagttataaaacatgaaaaatatttcaaatagtataaaatatatgtgaatatttatatggtgccagaaagaatatcttagaagaaatacaaaggaaataacctattttactacaaaaatatgaacgttttaaaacccaaaacaaattaatggcttattgctagctggaaatttctatgcactctggaataactatgaagcaagaccaacattctaggagaaaattatcagtatttgttaagagcagaaaaatgatcattttaaaaatatattaattctcaatctaagagtattctagagagtactaataaatgtaaggaaagataaaacatcaaaatatcaccttaatacaaaaaggagtggaaattttataattgactaacaccaggttataggttaaattaattgtgctacatcttataacagatcaagagtcaccattgaaaaatcattcttgaaaagagcatatcttgctgtgaactttgaagagactatttatttatatgaacaaatacaatataaccttaaatgacatcaaggaaaaaaaaactatttttcagtacaattccaatttcaaaaccttaaatataatgaatgtcacatgctagactattcctagatactcttgcgtttggggtttatcctcctaataattatgtaacaggatgttataacactatcgaactaccctggttttagtttcagctaaagccccaagactattattgagaccaccatacagaaattgtaaagaggagtcattaacccttattaggaacacttagcctgtgaagataaaaagacccaggattagagagaacagtttgttgatgtgtaatgagtcctacacacttgtaagatggaggggtcagtgtgcttgcccttcaaatcatgctttaggaaaggggattaaaggagatgtgcaaagagtttaatatacaagccgaatactttggagaacacagtggacttgcgtctgccttacagacacacctgagacatctaacatggaaggatctggttggctggtttatgacagcagagggaaggagagttggtgtcactcgccaactgacactcctagagtctttctggacaaaagatgcattagtgttaatggcgaagctagggatgagcgacacatgtgagtgagagttaactttggtactctatagtgaggtgaattgtcagatttctcacggccaaggaaagagccagcagcagccagagatgaattgccccgcatgaagagaacgcttgttaagaaattcacagcaataagttggtatctccaaagagctataataacactcagaaaagtaagggtcagcttaaaactctgtccattcccaggaacacctcatgacaacccgaaaaagagaagtaggactttccctgcctctttctgccactctaaacttgctcacccacaatcctggtgaggatgggagctgagaatgacaagctggagatgaagatactgcagagtaagtcaggaaagagaaaagaagccaacggggcatccttgttggaaattttacattttatttattattaggctgaacaaattcattactataccatttttattattagaaatcaattagaaaactagtacgatttattccatccaaatttcacccaaaggaaagggagaaatttagcttcaaatattagacttaaaaggttagcagcatacaaatatagttgctttcacattgaatatcacgtcatgcttgatcaatgcagctgctatataaaaataaagttgtccccatttcttgtattttagagaatccaatatctacctatctcccccaccacagtgtgcccaggattttcctggatatagatgattttattcctgttcctgcctcatcacttatagctgtttatttctctctgcccagcactaattcaaacattacaatacaagtcctctaccttgatatttaaaaaatatctctcacaaagggagttatatttaatagactcctgctcacaacttggggttataggcagggtgggggagtacttttttgtgtattataaaagttagcataaaattaaatataaggcacactagattttagaaattccttggccatattcacctcactgaacttcattctggttagttttcaaccctcaagttgcccaattcccggctgtgttgctgaccttcacaatcctgggagatcatcctatatgtttcccaacttttccagtattagttatggggcctgggtcaggttacttagcatcttcctatctttctttccttttcccttaaattgggatactatgagtagctacctcacaggattactgggaaaattaaatggactgacatgtataaagcaattagcttagtgcctggtacagagtttatgtttcataaggtactcagcttgcattttgtttcttctactcatcataagtatgccctagagggtaaggtagaatgggagtggtttccttcttacatgaaaagaactcctcaaaatgttttcctaagtgaaacagttctcactcccaatacaatgagttacctccttgaaaataatattattttcctctcctggacttgtatgtcaaaaaatacagtcaaaagaattgtatgaaatagactaaaatattatttatgtgtatttctggatataaagttgtgaaagttatttttatgcatattgtattttatatatcaaatctgaatttcttttctaaaaacagagatcttacttattaccaccatgccttactaacaatttcatgaatataggcgatcaatgaacttaatcaaagaaggtctgggacattgagagtggtgacttaggaccctccttcctacattagatgctcacttctggcccagagcaagtgatgaggcctccaaggagggttttgcagtgttatataccacagcagagtgagggttcagtctataaaatatctctattttatacagtttgtatgacagtttccagggagtcatgcctcataaattcatatgttctgtatttatttataagcaatacttagggatagcctattaaagaattaaataaagaaggcttatcctagtaaatatcattagtctaccttgtggttcaattattatgttcacaagaacattcatttcaatcatcagtcttcttttcatttcccctgggtgcaatctcctggtattgggggagaaatagatttctggccagttgctttaacagcatctaccaattcactgtctgaactcagttaatatcttcttgccacacatttctctagttattattatttgttttactatattttaacaaagaattaaggcatctaataccttaaaaaaccccaaaagaattggaggaaatagactaaaatattatatatgtgtatttctggatataaggttatgaaagtttatttttatgcatattatattttatagatcttgttcaaatcaacaagattttaactacctaatagggactatgaataaaatatatccatagtgaaaatatttatttaaaagtcttttgatacatttattccatttaattagtgtttatcttcaattgcacattttatatgatttgatggagacacttaattgaacaatgcaatgtttataaggtcaaattcactttcttctctggacaatccattttaacatgtttttaatcaatgggaggattcaatccaacctctcaaagtgtttccttttcctgggaagcatcatttgcataagtctagttttcacttacttatattaataaattacaaaccctctaatacaccttgtagctatgatagagagattgatgtagtgtttgacacaccatacattagtaaaacttacagtatcaatcagggcaatgtgtctcttcttttctttagattacagattactaagaacccaatattcctttttcagagaaaagaagtccaaggattttctttcaatattggccattagtcagcacccagatctgagagagatgtccaacagtgttattcttgagcttatttattttgcataactgaaactttattccaattgaagaactcccatttttccctccttttaacttttggtaaccaccattctattttctgcttctaagagtttctcatacctcatatgagtggaatcatgtagtatttgtccttctgttgctggtttatttcacttaacggtaatgtcttgcacattcatccatgtcgtgagaaatagtaggatttccacagacatttttaaatgattttctctgttgactgactgtggggtgcagtttcttatctcattagccagtgcatggcctgagaacccagtgcctgctcacttcaagaagcagataataattctggaaatctgactaaagcatctgccttattccaaatctcttctgagtcaacaactagttatttctggtagttatgtacatgacacacttgaattcttccctaaattccatgaaatttgttgttgttgttgttgttgttttttaatgaatgcccattcccttgacaacaacaacaaggccattggctataagtgaaaagtctttgaactgctttcatctctgtccaatgtgcaggtgtgcccttgtcttcttccattaagctttccccatctgcagggtgtattgccgttgttttccaaacaagtgacataatccagaaactctcatcagtgaaccagacaacttactttgcttcatggggagcaattcgcaagacacagaacatgcagcaattaacctggaaaagtctgctgagggctttatttgatcggctctatagtcagtgaggcaacctgcttgatatggtttgactgtgtcctcacctaaatctcatcttgagttgtagtttctatagtccccacaagtcatgggaggtgcccagtgggagatacttgaatcataggggtggttacccccatgctgctgctctcatgatagagagtactcatgagatatgatggttttataaggggcttttccctttttgctcagcacttctcttgctgctaccatgtgaagaaagacatgtttgcttccccttttgcgatgattgtaagtttcctgaggccttctcagccattctgaactgtcagtcaattaaacctctttcctttataaattacccagtctcaaatatgtctttattagcagtgtgagaacagactaatacactgctcctgtatgcagtgattcccttctgtgtacttgcccacttcccaaagtatgctttttaacatcccatttctaatttctgagtgaactttggctgtgctgtttgatccctatatgaatgtttctgacatcatccaagacaaagttggtttccctagctttggagttatctgatgcccttctgttagggcacagttttgatgaccaccactcagtaagaagcaatcaattgtcttttaaatggtttattaggaatagctattttgcctaacatttgttctcaaaaaataagaggtcttcactgaactctttcatttctgcagatagctctagtctgtgtatgttctggtttcgggtgcatctaatattatctgtgcagtcaaatcatacaatcctaatagaccttcctgcatcaccaccctccaaaaatcctttagcaatttcttctgctcagagcctctactcaaattcagttatctttctggtgactttgtgaacagaggtcaatagcattcttagattgaagaaaacaaaaacaaaaaactgcaaaagcctaagtaagctctatttatctctaggtctcttactcatttgcagattctgtaagcgataattttttatggtttcaaaaaatgtctctagttgctccagtcaatgtaattccaagggctatggatattatctgagctcatcagcctggctctatttgtcatgtgagtcaccacagtccttaactcctctttaattcttatgagaggagaagcttttataatataatcaatttactaacttgctttgcatatttgttaagtccaggtcccacttcatgaaattatcaattgtgcaggcaaattcaaacatacttctggcaatatagtaaatgtatactgagtcctattctgtgagaatgcatattgtacctggctgttcctggaaattgagatggagaagaaagcactaggcaagtttctaatgacatagccatcctccttggcttgttgtgcatcctatacagtgtttaccacatcaggtacagttgaagcaattaggacaactacttgttgaatgcttgataatctacagttaaccttcagggactggccagacagctctgttaatggggaagctaatgggaaccaataatcatacctcaagtattcccttaatcagggcaataatctcttgtacgttcctggaattctgtattgtttacaatttattctaggacaacataggaaattccaaaagtcaccgttcagcatggccagttaaaactccaggaagggtgattaggcaatatacttccccaacaaaaacggaaaaagggaacattctctattagcacataatatctatcccaattatgcattcagctaaaggccattaaccagtgaaaagtctccccagtcatattcttcactcctaaacttattctgatgctagtccccccaacatggcatctccaaatcctgctagtttcagctttgggtctttcatagcactgccttgatttatcataagtgctactgaacattgaaaacctctatctagtcattttagaggctttgcctaccagttcctggcttttttaccaggatttgctggatttttaccaaatatttgcaaaaggcctatgattgcttgtttggggtaggataagaatatctcagtctctcagccaacctttttcagactcaatgactttatctatggaaacacattcaggctgctgtttaagtactttccattttgaatcttgattctcatcagttgatttgatttttctagactataataatttgagtgaacttgcagtgacactttaagaagtgggagggaggatcagagcagctccccaccttccaaatgtggatactgttgttctaacttcttagtagaaacagtaagattctttctctctctttttacactgctttttataaaccatctaaagagctccactaagttgaggggattcttatttcctttttctcttcatggtcctttcttttgtgtgcatagatctttttatcatcatgcagccccctctgcattacctgagctggcaggttcatcatcatctcctaaatattcccttggtttcccattacataaggagaacaggagacagaagctctccaaagtagcacgtgtttcattatctgtgccagaaacattaaattgattgcgtctttctgatcatcaaatagacaggttggtgttggtcattcacaccatgcctgaagcatgaaaagacatatgacacttgtgagtcatatgtctcatatgtctcacaatgagtcatgttgtgagtcatattgtgacatctgtgagtcatgtgtctcatgtgtctcacaatgagtcacattgtgagataggaaattacctatctcacaggggaggggatagggaatttacccctctcaggagagggttgctatgcttctacttttaccggttatatagattaattattataccacatgaaaatacctgcttacagaagttttcagacactggggattagccttcaacttacatagctctaaaattagtgaaatttcctagacaggtgaagaagccctgcaagtaatgatttacctggcttctactggtatttttatgtaaaacatttgaaaatttacacagaatatccttgggatttagtagtcacctgatcttaacctccagttatttgtgtattttttgagtaatcaatggccttgtttatgctactttgtgaagaagtgggacatcattccaagtagtcatataagtacaagtatgccttccatgacaggaaagaaaaggctcacagcaaagaatagtagaatttggaaattttttttcttaggattgggtaattataagcaatacatagattttattgttctttgcttgaagggaacttataggtcttactttatcagcaccactagcactagccaggggatagaaattgttctatcttcccctcttccagccacccttcatcaatccatttagccatttccctcatatctaagtgtacttcctccacattccattgcatcaaagatttgctatcatcaatgtcctatcatcaatgggtaggactcaacttgtaattagatcttcactatattttttatatactttttattgctaaaaatgacccagcccattaagatttatgagattaaagcatagttctgcttgcactgccaatctgtgctaacacaaagtctcagactggcaaagaaacatggttcaaaagctttaccagttctgaaatgtactaataatttcaagaatacaggcaaccaagaggctcagacagccctggggggttgtctgcgagtagaccagttccctggcactttccatgtttgagatgtagtctcaggttcgaatagaagatgaggtctcctggtggagttttgcttggttgactcacacagcagaggaatatttagtctataaaatattgccaccttatacctcagtttaagggacattttccagggagccaagtattataaatccttagggtcttaatttattaatgttttctacaggcaatcctttaccagggacattctgttaagaacttttcatagataaggacttttctagaaatatgaatagactatttgcccagagcttcagttatcatgttgacaaggagattatattgggtcacttgccctcttattttctcccagggtcagaaatgaatagccagtcagcagctttaactccttcctgttcaaaaaagtgtgcataaatataaaattcattgaatttttaaaaactgaatatatgcttgtaaccagcacacagatcaagaaatatccctattccagctgcccagaagcctcccctcatgcttgtttcctgtgactacttccatccaggggcaagtaatcaccatgatataattttataattaaaaatgtgttatttgaaattgttgattggtacccctataagaattcatatctagataatcacatatacacatgtgtagatagtaatctcttaaattatagaatggggtctaacttctgtctgttatgtgaaaatatgaagctttctaagcatgtggctttcaaaagttttcttaggatttggcaaatgtaaataatgcatagatcctgtcgttctttgtttatattaattatttgagtacaacatgaatatatttgtgctgtaaaaagattcaagcaataaaaagtagtaaaatgtaaaagctttttcatcaccttataacacaatcttctcctgaccccagaagtcacccctactaatagatatttttctattagagttttgcttttgacatgaacaacatgttatagaccattatgtgtcagaataattagactcttcctattgattgtaatggctttattttattatagcacaaaggttaccataaagtctctgaagtcagactatctgactttaaatcttgaccttgctacttccctgctgatgaccttgtgccagttacttgctttttccccagtttcttcacctaaaaatgggaacagtgataatcatagtattttcccagaggattaagtgaattaatagggataaagtttataacagaccctggcagaggtcaagcattggatatattttgccattattaagatgttatcatattgcacatttgattattaatattgctataattcacttaaatttttgtctgttcatggccaatatgttgtttctaaacttttcctataacaaagttacaatgaatataatgctttcatggctttttactcatggatgtatttatttcaataaattatatttgtagaaatgaaaaggtcaagtggaacataatgcacattttgatttgactggcattcccaaattcactttcaataagtcttatcattgtatccctaacactgtatgaaaatatttgcttccctgcatctgttgtcagccaacatcagatatcattaatcttttaaatttttgccagtgggatggatgtgaggtttgattattagaaatatgttcgctgtgactgggagggcatgggaataactgcgtctaaacaaggtcttagaccaagtctgagcatgtgtgtccttggtcttataggcagaggtgtagtgggtactattgggttcagctgatccaaaatcagcttccaagtttacctcaaataactcccctgggttgtctcctatttctgtatattgtaattctgatcttggagccatctctaaagcctccattttcatgaaagttctttcttagatgagttttaacctagaatttcctgcagtcttgtttctctttattcaaccttaacagccttttgtgttctggtcctttaagagcactcttcttttgttttccaatgtatctatagattgtttattaatagtcttcactattttctttagaacttttaatttagacttcataaaaggtattgttgcattaaagtggttctcactttcgaacaagtcattaaaattgatcattctagtttgggacaatattaatatctcttggattgtatgggcaatgaaactgtagtattctaatacacacattagaattaaaattaaaaattagtcatttttacacattgatttatacatttattaaaataagaatgaaaggatgccagagtaggatatccctagcaatatgtttttccactgcatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaagggaaggaaggggataaagggtgaaaaactacctattgtgtactatgctcactacctgggtgatgggatcattcgtaccccgaacctcaccatcacacaatatacccatgcaacaaatctgcacacgtacccctgaacctaaaataaaagttgaagttaaaaaagaaaaaaatagtacttttgaaataaaaagcaagaagaaaaatacttcactgacactataaaattaagagggaaacctataaacagttcacttgaggtgtaaaagtataacagtcatttaattaatgggcttatttcttttatgggcattcgtttgattaaatcttttgttcaggcatatttataattttatattatactgtcactctggtcttctacattgcctcatttactgtacttcttttgtttgtgttgtatcttcttttcagtttagttgtagttgttagggtccacccaactggacagtttccccctcctatagacctaagccccaaaggccaaaagtaaaaccccctaccccaaacctgcctgtatctgtctgaccagaggccagctgttccaggatggggtcaagacgtctaccttacacaacagaactggcaagaaaaacatctccaggaagtggtcagacacctggcacaaaggaccccccacccttttctttttccttcaccctgacccagttctatgccctataaaaccttgctatagcctgtaagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagcaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaacaatttcggtacccagtccttgagataactttctgaaggaatgatgttaacattaatgaataaaaaaggaacaaataaaaagtacaccacacatactttgcttgtgttctggtagcactagccctaaacacaatatgagtaaggtaacaaaaaagtaacctgagatatattaaaaatggttttaaagccaaaagggaggaagaaaggaaaaaaggaaggaagggggaagggcgaaagtgaaaaacatatggaggaaggaaaggaaaataatatcaaatgttcacagagtgcttattctgaattatgtaccctcttatgtgctttatataaattatattgtaaggttgaaaatatgtgctctggagaagagctgcacggaataaaatcccacttctgctttttactgatggtgtgacatttagcggattagttaatttggtcattgcttcagtttcctatttgactgtcctaccataagactataataaaccaatgcatataaaaatgcttagcactgagtctgacatatggtaagcatacaataaattttaactacaattatccaatgaaaacctaacaacaacactatgaagtttgtataattattatttttacttttttgataaggagtctgaatcacaaagggattaaataatttactcaaagtcacgcaggtattaatcatgaatctatcttccagtaaatatcaatagaaaacaagatgtgggatttgagtgcaggcaattagactccagagcctgtttttaaactctatgttattacaagaagacatgcacgtacctttaaaagaagaaaatttgagacagcaaatgcttaacaaccaagaaattacaaaagaaaaaaacctacaatctatgaaacaaaaattatatgatgagattaattaatacatttaacaaatacttattgagcaccaattattggttcaaccatgcttttaggtactgagaattcaactgtgaactggtctctactttcacagaatatactttataatacagtataaaatggcataacaaaatggaaatggggttggtaaaggcagcaaaaatcttcaacagaaaaataaatatttttataaaccaataatttttgaaagataggatatagcatataagcatatggaaaataggtatccatgatagagaatataatagtggaacagttaatgacttctgacatgaaggaagtactgagatgagaattgaacaggatttgttttccttcagaaaaaaaataatcggtagaaaaaatatatgctggtatagctaaaaaaatttgaggattaaaaaatctcttctatacaatatataaaaatgcatagcacctgtaagaaaacaaatatattgggttggattcaaatttttttgtaccaaaatttccaatagataatggagcaagtctgcaaggatatgggcaaaaaatagtgggatctaaatatgttgtacatagattgttattcctgtcaaagggatgaggagttggtctcatatatgtactaacacagcagatacaataattcggaaacttcttgagaagctttgtagttatatatacactgtaattatttataatactattaaatgcaatataacaatttaatacatagagaagctgccttattgaaatattgaaataagcattgaaaaatctaaatgtagctggcaagatggcctaatagaaacagctctggtctgcagctcccagcgagatcaacacagaaggcaggtgatttctggatttccaactgaggtacccagttcatctcattgggactggttagacagtgggtgcagcccacggagggtgagctgaagcagggtggggcatcaccccaccagggaagtgcaaggggtttgggaaatccctctcctagccaagggaagccctgagagattgtgccttaaggaatggtgcattctggcccaaatactacacttttcccatggtctttgcaacctgcagaccaggagattccctcaggtgcctatgccactagggccctgggtttcaagcataaaactggggatcatttgggcagacacccagctagctgcagtttttctttttttcataccccagtggcaccaggagcccgagtgagacagaacccttcaatcccctggagagagggctgaaatcagggagccaagtggtctggctcagtggtcccacccccacggagcccagcaagctaagatccactggcttgaatttctcactgtcagcacagcagtctgaagtagacctgggaggctccagcttagtggggggagggacgtccaccattactgaggcttgagtaggcagttttcctctcccagtgtaaacaaagcctccaggaagttcaaactgggtggcaaagccacagtagccagactacctctctagattcctcctctctgggcagggcatctctgaaagaaaggcagcagcccaaacaggggcttatagataaaatctccctgggacagagcacctgggggaagagcggctgtgggtgcaacttcaacaaacttaaacattcctgcctgctggctctgaaaagagcagcagatctcccagcacagtgctccagctctgctaagggccagactgcctcctcaagtgggtccctgacccctgagtcccctgactgggagacacctcccagcaagggttgacagacacctcaaacaggagagctctggctggcatctggcaggggcccctctgggacaaagcttccagaggaaggaacaggcagtaatctttgctgttctgcagcctctgctggtgatacccaggcaaatagggtctggagtgaacctccagcaaactctagtagacctgcagcagaggggcctgactgttagaaggaaaactaacaaacagaaaggaatagcatcaacatcaacaaaaaggaagtccacaccaaaaccccatccataggtcaccaacatcaaagaccaaaggtagataaatacatgaaaatgaggagaaaccagcacaaaaattccaaaaaccagaatgccttttctcctccaaaggaccacaactccttgccagcaaaggaacaaaactggatggagaatgagtttgacaaattgacagaagtgggcttcagaaggtgggtaataacaaactcttccaagctaaaggagcatgttctaacccaatgcaaggaagctaagaaccttgaaaaaaggttagaggaattgctaactagaataaccagtttagagaagaacataaatgacctgacggagctgaaaaacacagcacgagaacttcatgaaacataaacaactatcaatagccaaatcgatcaagcggaagaaaggatatcagagattgatgatcaacttaatgaaataaagcgtgaagacaagactagagaaaaaagaatgaaaaggaacaaacaaagcctccaagaaatatggtacaatgtgaaaagaccaaacctttgtttgactggtgtacctgaaagtgacagggagaatagaaccaagtgggaaaacacttttcaggatattatccaggagaacttccccaacctagcaagaaaggctgacattcaaattcaggaaatacagagaacaccacaaagatactccctgagaagagaaacaccaagaaacataatcatcagattcactgaggttgaaatgaaggaaaaaatcttaagggcaaccagagagaaaggttgcattacccacaaagggaagccagtcagattaacagccaatctctctgcagaaaccctacaagcaagaagagagtaggggccaatattcaacattcttaaagaaaagaattttcaacccagaatttcatatctagccaaactaagcttcataagtgaaggagaaataaaatcctttacagagaagcaaatgctgagagattttgtcaccaccaggcctgccttacaagagctcctgaaggaagcactaaacatggaaaggaaaaaccggtaccagccactgcaaaaacataccaaattgtaaagaccatcaacgctatgaagaaactgtatcaactaacaggcaaaattaccagctagcatcataatgagaggataaaattcacacatatcaatattaaccttaaatgtaaatgggctaaatgccccaagtaaaagacacacactggcaaatcggataaagagtcaaaatccactggtgtgctgtattcaggagacccatctcacttgcaaagaaacaaataggctcaaaataaagggatggaggaatatttaccaggcaaatgaaaagcaaaaaaaaaagcaggggttgcaatcctagtgtctgataaaacagactttaaactgacaaagatcaaaaaagataaggaaaagcattacataatggtaaagggatcaatgcaaccagaagagctaactaacttaaatttatatgcacccatacaggagcacccagattcataaaacaagttcttagacacctacaaagagacttagactcccacgcaatagtagtgggagactttaacaccccactgtcaatattagacagactgatgagacagaagttaacaaaaatattcaggacttgaactcagctctggaccaagcagacctaacagacatctacagaactctccagcccaaataaagagactatacgttcttctcagcaccacgtcacacttattctaaaattgaccacataattggaagtaaaatactcctcagcaaatgcaaaagaacagaaatcataacaaacagtctctcagaccacagtgcagtcaaattagaactcaggattaagaaactcactcaaaactgcacaactacatagaaaccgaacattctgctcccaaatgactactggttaaaaattgaaattaaggcagaaataagtaagttctttgaaaccaatgagaacaaagacaccatgtaccagaatctctaggacacaattaatagatcttcctgctttctcctgtgtgcatttagtgcccataagagaaagcaggaaagatctaaaattgacaccctaacatcacaattaaaagaactagagaagcaagagcaaacaaattcaaaagctagcagaagacaagaaataactaagatcagagcagagctgaaggagatagagacatgaaaaacgcttgaaaatatcaatgaatccaggagctggtttttttgaaaagattaacaaaatatgtagaccactaggcacattaataaagaagaaaagagagaagaatcaaatagacacaataaaaaattataaaggggatatcatcactgattatcatcactgatcccacagaaatataaactaccatcagaatactataaacacctctgtgcaaataaactagaaaatctagaagaaatggatacattcctggacacatacaccctcccaagactaaaccaggaagaagttgaatccctgaacagaccaataacaagttctgaaactgaggcagtaattaatagcctaacaaccaaaaaaagcccagaaccagatggattcacagccgaattctaccagaggtacaaagaggagctggtaccgttacttctgaaactcttccaaacaatagaaaaagagggactcctccctaactcatggaatgaggccagcatcatcaggataccaaaacctggcagagacacaacaaaaaagaaaatttcaggccaatatctctgatgaacattgatgcaaaaatcctcgataaaatactggcaaaccaaatgaggcagcacatcaaaaagtttaccaccatgatcaagttgacttcatccttgggatgcaaggctggttcaaaatatgtaaatcaatcaacgtaatccatcacataaacagaaccaatcacaaaaaccacatgattatctcaatagatgcagaaaaggcctttgacaaaattcaacagcccttcatgctaaaaactctcaataaactagatattgatggaatgtatcttaaaataataagagctatttatgacaaatccacagcaaatatcatactgaataggcaaaaactggaagcattgcctttgaaaactggcacaagtcagggatgacctctctcaccactcctattcaacatagtgttggaagttctggccaaggcaatcaggcaacagaaagcaataaggtgtattcaattaggaaaggaggaagtcaaattgttcctgtttgcagatgatatgattgtatatttagaaaaccccatcgtctcagcccaaaatctccttaagctgataagcaacttcagcaaagtctcaggataccaaatcaatgtgcaaaaatcacaaacattcctatataccagtaatagaaaaatagagccaaatcatgagtgaactcccattcacaattgctacaaaaagaataaaatacctaggaatacaacttacaaggtatgtgaaggacctcttcaaggagaactacaaaccactgctcaaggaactaagagaggacacaagcaatgcccatggataggaagaatcaatatcatgaaaaatggccttcctgacaaaagtattttatagagtcaatgctatccccatcaagctacgactgactttcttcacagaattagaaaaactactgtaaatttcatatggaaccaaaaaagagcccatatagccaagacaattctaagcaaaaagaacaaagctggaggcatcaggctacctgacttcaaactgtactacaaggctactgtaactgtacagttacagtacggtttggtaccagtaaacagcatggtaccagtaccaaaacagatatatagaccgtggaacagaatagaggcctcagaaataatgccacatatctacaaccatctgatctttgacaaacctgacaaaaacaagaaatggggaaaggattccctacttaataaatggtgctgggaaaactggctagccatatgtagaaggctgaaactggaccccttccttacaccttacacaaaaattaaccaagacggattaaagactaaatgtaagacctaaaaccataaaaaccctagaagaaaacctaggcaataccattcaggacataggcatgggcaaggacttcatgactaaaacaccaaaaacaatggcaataaaagccaaaattgacaaatgagatccaatgaaactaaagagcttctgtgcagcaaaagaaactatcatcagagtgaacaggcaacctacaaaatgggagaaaatttttgcaatctatccatctatccatctgacaaagggctaatatccagaatctacaaggaatttaaacaaatttaccagaaaaaacaaccccatcaaaaagtgggtgaaggatacgaacagacacttctcaaaagaggacatttatgaggctaacaaacatatggaaaaaaagctcatcatcactggtcattagagaaatgcaaatcaaaactacaatgagataccatctcacgccagttagaattgcaatcattaaaaagtcaggaaacaacagatgctggagaacatgtggagaaaagggaatgcttttacactgttgtggaagtttaaattagttcaaccattgtggaaaagaaaacctccaacctctcaactatgtatatagaaagtccaaggaaaagatctcaggtaatactacaaaaattgggaagtataggtggtctattgatttcctattagtgcggtaccaagttgtcacacttagtgtctaaaatagcacacatttgttatcttgtagttctgaaggccagaagtctggaatggtttccactaggctaaaatcaagatattggcaaggctgcgttttttttcttaaggctctacagaagaatctgacttcttgcttttcttttccagctactacacgttgtctgcattccttggctcatggtccttttaatctttaaagccagcaaaggcccatcaagttggtctcacctggaagagctctaatactgatgcttctttgtctcttccacttttaaggactctcacgattacattaagcccacctatataaccaggatatcctattttaatataagctaactagcaaccttaattcccctctgtcatgtaacctaacctattcagaagttctggagatttggacagagacacttgggaagccattatgctgctgaccataggtggtaggaagtttaaattttatagctaaggacaataagcattcattcatttctgaggtagattaatattgaaatattttacatttatggaatttttctaatttagaaattttctaatatttcctcaggataagattatgcatttttgacaaaaatattgctaaactgatgttgaattctcatgcattacatcaaggagcatatgatatacttgcatctcattatccaaaacgttatcttggatcatttaactacggtagaatctgcccagttttttcactgaaaagttacaattttaactttgaaattaataaagtatcttgtgggtagataatttcagactatgtaactatcctgtttcaaatttttgtccactgctttaagcagtcatttataattctttgctggaacacaccaacagtgtggggaggtcaattttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcatcctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcggtggctcacgcctgtaatcccagcactttgggaggctgaggcaggcagatcacgaggtcaggagatccagaccatcctggttaacacagtgaaaccccgtctctactaaaaatacaaaaaaaattcgctgggcgtggtggcgggtgcctgtagtcccagctactcgggagggtgaggcgggagaatggcgtgaacccgggaggtggagcttgcagtgagccgagatcgcgccactgcactccagcctgggtgacagagctagactccatctcaaaaaaaaaaaaaaaaaaaaaaaaaaaagtcatacagattctaaataatttcttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaataatttcttgatacattgtgtaagaacagaattatgctaagtgaaaccaagacaagtaacctagccctatattaagagactcacaatatggtggctgtgtctgcatacagaaatataaaaaaataatattcaggccacgcacggtggctcatgcctgtaatcctagcattttgggaggctaaggtgggtggatcactcgaactcaggagttcaagaccagactgggcaacgtggcaaaactccatctctactagaaatacaaaaattagctggtcatgatggcgtgcacctgtggtctcagctacttggggggtgaggcaggaggatcacttgaacctgagagatcaaggctatagtgagctgagatggtgccactgcactcccatccaggtgacagagtgaaacccctgcaaaacaaattaataatattaaattaattgagtcagagcagaatatggcaaatacaagaagttatttctttaggagtttcaaaaatgtagacctcgtatcttcttcagattatcaggaaagctagaggcatgtgagttagctttaaattaataagtgagtcttgacagaatatgatacctggaggtagagggaaggagagttttggaaggcaagggaaatggatagagtgcatgccaaaagaagtgaaatatagagtgtattagaaataaaatataataataaccattacttatggcacaaattggaattttcaaatgctcttggttaaaatcctaataatttcagtgccttatttataattcagttttatgtaaaacttatagattattatagaaagaccacaaaaattccatggcattttacaagtgttcctcttaaactcaggcacagaatttatgctttactggttcctaattatgtttttcttttctgtctcttctttattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggtatgttggcttttgtgcagtttgaagataatatgaaatatttgtcccatatttcagcagccattggcagggctgttcattcattcatttatttacatatatttatggaattccaggaactgatccaggcacctgccctcattggatctgcattctgaaggactagatggacaataaataattatattagagaatgagaaggattctgaaggaaagtaaaagtgatataatagaaacagaaagtggaggctgctatttttatagagtattcactggaggtcatgagaaaataagatttattatgtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcctgcaccgcccttaatccattcaactctgagttgacacagcacatgtttcagagagcacggggttgggggtaaggtcatagattaacagaatctcaaggcagaagaatttttcttagtacctaacaaaatggagtctcctatgtctacttctttctacacagacacagtaacaatctgatctctcttgcttttccccacaattatgtcttacctgaaacctttgtattttcttaataaagttcagggcacatgtaagatgatagaaatatcactatgaactgtaaggtccaaagaactgacacatctgatatgattatgtcttcagtctgacataagtagaaatttaggccctcatgtggttagctagagagatttccaacagtttttgagagaagatgcaacaatattaatgatttttcaaaaagtggtagtttatgtgtgcaacataagtttacattgtaaagcttagggtagcaccctaaagtacttctgggcccacagaagtactttaccttactgcatagatctgagtttttgtgatgtttatcattaaaaaaaaattttattgaggttgtgatgaaaggacccttcccttgacccctgcttgggactggtgaaggggcggctcccttactccacctgcaactctcaagccccttgtgggagggggagcatgcaggtgagagggtgcaggagctagggcaagtgcttttgggtgccagcagtaactaatcctgtaccagccccagggctgtgtctagaggttgcctgtgacccctggagccccagaaagcagacagctaagtgttaaccagctcagtggagggtcagggtgacagcattttgcacctgtcctcttggtacctgagttcctgtctggcattcaggaagaatcaggtcgcatgaacgaattgaagtgtggtgaatgtggaggattttattgagcggtggaagtggctctcagcaggatagagagctggaacggggatggagtgggaagatgattgatggtccctggttgaactcctctccaaccatagtctccaatgcccagctgttttttttctcgatgttcagatgcttcttgtcttctctccttctctgccgcaccactctgctgctgtgccattggaacctggggtttttataggtataggatgcggggcgtggcagggcaggatggttttgaaaaaggcaaatttcaggtgggaaaacaggattgcatgttctcacttagagcccaaggtccaagcttgaaggtggagtccttgccagggactgcgcccttttctaactagtatttccttgcctcctgtccatatcagttacattatcaagatactgtgctaaacaaaaagagggtgtacaccgcatattctcactcataggtgggaattgaacaatgagatcacatggacacaggaaggggaatatcacactctggggactgttgtggggtggggggaggggggagggatagcactaggagatatacctaatgctagatgacgagttagtgggtgcagcgcaccagcatggcacatgtatacatatgtaactaacctgcacaatgtgcacatgtaccctaaaacttaaagtgtaataaaaaaaaattgctaggagttataacatttaacattataacattatataacattataacatgtaattcagactactggaaatagatttacatgggtgatttgtaagaacagtaaaatgtgattttactaaaagattataaaaaagcatggaaatgtaaatttttgcctagggttgaaggattgttttgaattagataagataaagctgaaggtttaaacaaatgatggaaggattctaaaaactaatcttgcaaaaactgtatgtgtgaacatatttactaaattcaaaggggtattataggatttttctgtaaattgagcattgaaataaaagtacaataaatgttaaaaaaaaaagagggtgtacaaattgataattattgttatcactcccagacaagtttttttttaatttaacttctatttttaattcaggggtacatgtacaagtttattacacaggtaaacttgtgtcatgggggtttgttgtacagattattttgtcacccaggtattaagcctagtacccattggttttttttttttcctgagtctcttcgtccttactccctctaccctctgataggccccagtacgtgtcgttcccctctatctcatcattagctcccacatataaatagtaacatgtagtattgggtttcctgttcctgcattagtttgctgcagataatggcctccagctccatccatgttccgtcaaaggacatgagctcattctttcttatggctacatagtattccatggtgtatatctaccacattttctttattcatctaccattgatgggtatttagattgattccatgtctttgctatcgtgaatagtgctgcagtgaacatacacatacatgtgtctttataatagaacaatttatattcctctgggtatatacctagtattgggattgctgggttgaatggtagttctgtctttaggtctttgaggcattgccacattgtcctccagaatggttgaactcatttacatttgcaccaacagtgtgaaagtgtttatttttctccacaattttgccaacatctgttactttttgactttttaatagtagccactctgactggtgtgggatgatatcccattgtggtttttatttacatttctctaatattcagtgatgttgagctttttttcatatgtttgttggccacatgtatgtcttcttttgaaaaatatctgttcatgtcctttgcccactttttaatggggttgtttattttttgtaaatttgtttaagttccttttagatgctggatattagaccttagtcaaatgcaaagtttgcaaaaattttctctcagtatgtaggttgtctctttactctgttgatattttcttttgtcatgtggaagctctttagtttaattattaatagattccatttgtaaatttttgcctttgttgtgattgcttttggtgtcttcctagtgaaatttttgcctgttcctatgtccagaatggtattgcctagttgtcttccagagttttcatagttttgggttttacctttaagtccttaatccatcttgagttaaattttgtacatggtataaggaaggggtgtggtttcaatcttctgcacatggctagccagttatcccagcatgatttattaaatagggagtcctttccccattacttgcccattgtttttgttagctttgttgaaggttagatatttgtaggtgcatggatttgtttctgggttctctattctgttccattggtctatgtgtctatttttgtactagtaccatgctattttcattaccatagccttgtggtatagtttgaagttgggtagcataatgcctccagctttgttctttttacttaggattgctttagctattcaggctcttttttgcttccatatgaattttaaaataatttttctagttctgtaaagaatgtcattggtgatttaatagggatagcatggaatctataaattgctttgggcagtatggccattttcatgatattgattcttcctatccgtgggcatggagtgtttttctatttgtttgtgtcatcatggatttctttgaacagtgttttgtagttctccttgtagaaatctttcacctccgtagttagctgtattcctagatattttattctgtttgtggaaattttgaatgagattgagttcctgatttggctctcggcttgactgttgtggatgtataggaatgccagtgatttttgtacattgatttttttttaccctgagacttttaggaaagttattttgccaataaaaagtgctctcaatattttgtcccatacatattttaaattacattaattagtttaaagttcttgcatacaaattacccatccttggccaggcagagtggctcacacctgtaatcccagcattttgggaggccaaggcagacagatcacttgaggccaggaattcaagaccagcctggccaacatggtgaaaccccatctctatgaaaaatacaaaaattagcctggtatggtggcgtgcacctgtaattccagccactcaggaagctgaagcatgataatcacttgaaccctggaggtgaggttgcagtgagccgagatcgtgccactgcactccagcctgggtgacagagagagagactgtctccaaaaataaaaaataaaaattacccatctttagctctttgtttgccttctcaggaggcagccaccttcagcaatttttgctttttttttgtaattactactatatttctaaataacatgttttcaatatttttccttcaaactctcatagatgtaaattgagttgtcatcaactttcaccacatcagcacaaacatacattcatacacttcaccttctcacattctcctggtataattatatcacaatttttgtttgaatcaacatacagaatatacattcttattttacatatatcttatccgtgctgagccttggaaagtgctgtatcaatttctctcttataaaatgtttttcattttcctagatttattaagggtatattttgatttgcttagtttgggtgtgtactcattagtaatgtatcctcaaattctcttccagaggtgttactctcttgtcaatacctttaaacatatcaggtatctataaatatacgtgcaggtacgtttcccggtgttttctgttctctttataggaacacgttactcccagggcagagcagctcctgctctgggataccccttcactgataccctaacaactctcttcacctctctttgtgtacaaccccattttctggatgccatgtccccttctttttttggtttattcctttctgagaaatggtttattgagatgaaacgtttgagctcttatttgtctgcaagtatctttattctgccctcacacttaattagttagctgtatgaagaagtctaggttggaaatttcttctgtcagaatttcaaaggaattactctattgctactgctataaaatatggtattactgctgaaaaaacatgatatttaattctttcttcttttgcccatgatttgtattttgtttttcttatggaaatcttttagaacttccctttatccctaatgttctcaattccatgaaactatgctttgaagtaagcctttttattttgtatttattgtgctggatataaattcgggctttgcaatctgaaaatgagtggcctttaatcttagggaattttcttgtggagttcttttctgtttttctttcttctactcatattaatcagatattagagattctggattgctcttttaatttttttcatctttttactttaattttttgcccctcattcttctattttcaaggattgtctcaactttctcttttaaactttatgttgaactcctcaatactgttaccgttatcttaaatattttgagttatttttattttctgcatatttctgtagttcccaccatgatacaacagtatcatgatacaagcagtatcatgtacatgtttcacggacaaagtgcattatatctctggtgttattagtaatagttttttctgttttctatttttcatatgtctgactcaatttggttttcctataagtatttttcttcctatgtgtgttagtctttttcttttatgtttgaggtttccctagtgttaactgcttatttttcattgcatttaaaaattgttttaatttgttttttttttagttaatatgggtacatatgtgtatatttatggggtacatatgatgttttgatataggcatataatgtgtaataatcatattagggtaataatcatattagggcatttgggatatccatcacctcaagcatttatcatttctttatgttaagaacatttcaattctactcttagttattgctaaatatacaataaattattcttgactgtagtcactctgttgtgctatcatatactagctctaaggctaggtgcagtggctcatgcctgtaatttcaacacttggggaggccaagatgagaggattacttgagcctaggagttcaaaaccagcctaggcaacataatgagaccccatctctactaaaaattttttttaaaataactggtgtggtggactgcacctgtattcccagctactcaggagcttgaggtaggaggatggcttgagcctggggacacagtggtggtaggagcagaggggttaaggctacagtgaaccatgatcacgccactgcactccaccctgtctcaaaacaaagaaacaaacaaaccaaaacaaaacaaaacaccaccagaaaaaaaaagactagatctagttaactgcttcttagcttctgtgtttcagagtgaggcatagcgtggctgcctggaagttctgcatgcctggaggataaggttaggactactgtccacttcattagtctggactattcattgggaaattcccaactgtaaaaatctgcatatcagtgttattgaacaggtcactttttccagaaggagattttctaacatactgccgtaggaatgtagggctggctgttacattccacattgccatgcagtgcagcggtatactttcgcttaatccttctgcatcacagtggcactcattacccccgcacctggtgactcggggtttagagtacttatggttctgcctcctcagagagtaaacctccattcttctatcaacatgaggaaaaagccagtggcatctaattggatttatatataatttccaccaatcatgttgttttctcaatctcacatttagtagtatctggcactttaatttctaaggatttatgctcttttatcctacacctatcatttcagtggaattgtgtgagggagataaggtaaaatatatgcttaatattccattttcaaccaacggctagacacagttttttgcatttttgttgacaaataatactatcataagctaacacattttagaactgaaaaagacattctcttttagtttccactcactagagtcactcaagcatttattataatatgatctggataggtgacttttaaaagatatacttgaattatttaggttatttaaaaatactttatgtgtaagaatattttgtttcagaaaataaattgcagaaaaattaaaaaaataaatttcaaaactctgagaaatgcataatattcatcttttgagaaatgagaatatttgctaggagaagaatattgttccttttctgtaatagcagatgggtgtttagaatagcaaactactacaataattttattattttcttttataaactttacagtagctaaggtttagtaggaaagtaatacttttgttcatgcaaagtgctctttattctggatgtgtctctggggttaattgtctcatttcagtctatattaataaaaacattttattctgtatgtaactcctgattcctcataattttggggtgcctttccaaactagaaaaccgacgttctgactgtttattcatttaaagggcattattgcatcagagtcaatggtttagactctggagtcttacttcccaggttcaaattcttaaaatgctcctaactagccgtggcaaagtatgtaatatttgtttatttgttacctcgtctatattgtgaggaaaataacaaagccttcaaaagcctgttgtgaggattagatatgttaatagacagagaccacttatagtgcctggaatgtgataactactatgtaagttttgacattattgttagtgtactgaaaagcagagctctggagatattaggggaaatactgagaaacattgatttttctctgcctatcatgtagaaaacagttacattagtctcgtttccacaactttctattttcattttcagtgagattttgaaaatatgatcttttgaaagactgtttcattttcctttcaggatggccatttggaaacacgatgtgcaagatcagtggattggtccagggaatatctgtcgcagcttcagtctttacgttagttgcaattgctgtagataggtaagtctgcaccaaactctgaatccagaaaaattggcatgtctgcaactagtataccagaaaaatatataacctactaaatttggacatatcttttcaaattgtattcacaatatctacctctttttttaaattattatactttaagttctagggtacatgtgcacaacgtgcaggtttcttccatatgtatacatgtgccatgttggtgtgctgcacccatcaactcgtcatttacattaggtatttctcctaatgttatccctgcccctgcccccccacccaatgcaggccccagtgtgtgatgttccctgccgtgtgtccaagtgttctcattgttctattcccacctatgagtgagaacatgtggtgtttggttttctgtccttgtgatagttagctgagaatgatggtttccagctgcatccatgtccctgtaaaggacatgaactcatcctttttatggctgcatagtattccatggtgtatatgtgccacaattttcttaatccagtatatcattgaaggatattttggttggttccaagtctttgctattgtgaatagtgccacaataaacatacgtgtgcatgtgtctttatagtagcatgctttataatcctttgggtatatacctagtaatgggattgctgggtcaaatggtatttctaattctaggtccttgaggaatcgtcacactgtcttccccagtgactgaactagtttacactcctaccaacagtgtaaaagtgttccaatttctgcacaccctctccagcatctgttgtttcctgactttttaatgatgacctttctaactggtgtgagatggtatctcattgtggttgtgatttgcatttctctgatgaccagtgatgatgagcattttttcatatatctgttggctgcacaaatgtcttcttttgagaggtgtctgttcatatactttgcccactttttgatggggttgtttttttcttgtaaatttgtttaagttctttgtagattctggatattagccctttgtcagaagggtagattgcaaaaattttctcccattctgtaggttgtctgttcactctgatggtagtttcttttgctgtgcagaaattctttagcttaattagatcccatttgtctattttggcttttgttgccattgcttttgttgttttagtcatgaagtccttgcccattcctatgtcctgaatggtattgcttaggttttcttctaggttttttatggtttcaggtctaacatttaagtctttaatccatcttgaattaatttttgtgtgaggtataaggaaaggatccagtttcagctttccacatatggctagacagttttcccagcaccgtttattaaatggggaatcctttcccattgcttgttttcgtcaggtttgtcaaaaatcagatggatgtagatgtgtggtgttatttctgaggcctctgttctgttccattggtctatctctctgttttgataccactaccatgctgttttggttactgtagccttgtagtatagtttgaagttgggtagcatgatgcctacagcttggttcttttggcttaggattatcttggcaatgcgggctcttttttagttccatatgaactttaaagtagatttttccaattctgtgaagaaagtcaatggtagcttgatggagatggcattgaatctataaattaccttgggcagtatggtcattttcacgatattgattctttctatccatgagcatgaatgttcttccgtttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagattatggggttttctaaatatacaatgacgtcatctgcaaagaggaacaatttgacttcctcctttcctaattgaatacactttattgctttctgttgcctgattgccttggccagaacttccaacactatgttgaataggagtggtgagagaggtcgaccctgacttgtgccagttttcaaagggaatgctttcagtttttgcccattcagtataatgttggctgtgggtttgtcaaaaaatagctcttattattttgagatacattccatcaatacctagattattgagagtttttagcatgaagggctgttgaattttgtcaaaggccttttctgcatttattgagataatcatgtggtgtttgtcattggttctgttcatgtgatggcttacatttattgatttgcatatgttgaaccagccttgcatcacagggatgaagcagacttgatcatggtggataagttttttgatgtgctgctggattctatttgccagtatttcattgaggatttccggatcgatgttcatcagggatattggtctaaaattctcttttttttggggggtgtctctaccaggctttggtatcaggatgatgctggcctcataaaatgagttaaagaggattccctctttttctattgattggaatagtttcagaaggtatagtaccagctcctctttgtacctctggtagaattcagctgtgaattcgtctcgtcctggactttttttggttggtaagctattaattattgcctcaatttcagagcctgttattggtctgttcagagattcaacttcttggtttagtcttggaagggtgtacgtgtccaggaatttatccatttcttttagattttctagtttatttgcatagaggtgtttatagtattctctgatagtagtttgtatttctgtgggatcagtggtgatatcccctttatcatttttattgcgtctatttgattcttctctcttttctcctttattagtgttgctagtagtctatcaattttgttgatctttaaaaaaaaaccagctcctggattcattaatttttttaagggttttttgtgtctctatctccttcagttctgctctgatcttagttagttcttgccttctgttagcttttgaatttgtttgctcttgctcctctagttcttttaattgtgatgttagggtgtggattttagatctttcctgctttctcttgtaggcatttagtgctataaatttccctctacacactgctttaaatgtgtcccagagattctggtatgttgtgtctttgtcctcattgatttcaaagaacatctttatttctgccttcatttcattatttacccagtagtcattcaggagcaggttgttcagcttccatatagttgtgctgttttgagtgggtttcttaatcctgagttctaatttgattgcactgtggtctgagtgacagtttgttgtgatttctgttcttttacatttgctgaggagtgctttacttccaactatgtggtcagttttggagtaagtgtgatgtggtgctgagaagaatgtatatgctgttgatttggggtggagagttcggtaggcatctattaggtccacttgttgcgagctgagttcaagtcctggatatcattgttaacattctgtctcattgatctgtctaatattgacagtggggtgttaaagtctcccattattattgtgtgggagtctaagtctatttgtaggtctctaaggacttgctttatgaatctgggtgctcctgtattgggtgcatatatatttaggatcgttatttcttattgttgaattgatccctttaccattatgcaatggccttctttgtctcttttgatctttgtcagtttaacgtctgttttatcagagactagggttgcaacccctgcctttttttgctttccatttacttggtagatcttcctccatccctttcttttgattctatatgtgtctctgcatgtgagatgggtctcctgaatacggcacagtgatgggtcttgactctatccaatttgccagtctgtgtcttttaattggggcatttatcgcatttacatttaaggttaatagcgttatatttgaatttgatcctgtcattggcgagagtgtcccgattttccaggtacagtctgtcatggcttcccttggctaggaaagggaaattccccaaccccttttgcttcccagctaaggtgatgccccgtcctgctttggctcaccctccgtgggctgcacccactgtccaaccagtcccagtgagatgaaccaggtacctcaggtggaaatgcagaaataacccatcttctgcatctatcatgctgggagctgcagaccacagctgttcctatccggccattttggaacggaacctgagaatatctacctctttaaaagcaacatacctactaaagtttcagtaataagaaaatgaaactattgaattttccatactttaaaaataaataattggagatggtaaaatttccctatttttcacactacaatatagacgtttctaacagcagaaatgcaaatgagctaaaatctgaaattttatctagattttaagattgaaaatcattcatccattcattcattcacacatgttgttgagcatttatgatgtgccagatactgggctgggttggtaacatctaaaacaaattagaagtgctgcctcaggaaggctacaatctggcggagcaggcaaagtcattaacaaatatttacaaataatgctttctaataggtgaccagtgtttgacagctatgcaaaagagataataatcaattctacctattaggacagggagtagtggattcacaaaagaagtgagaccttctgattcctggagaagtcagaaatttacccttagaagaaactgggaaaagggcatcccttaagacaagtatatacttatggcattgaaataggaggcacttgttcagagaaatgtagagaggtagttcagctggaacaaggcaggtgaagtggtacatttgtccacaaagagagagatttattacgagaaattgactcataattatgaaaactgagaaatctcagaatatgctgcctgtaaattggagacctcagaaagccagtgatattattcagtccaagtcccaaagcctgagaactagggatagccaattgtgcaattggccatttgtgtaaattgcatcctgtgggcaggagaatatgatatgagatgtcctagctcaagcaatgagtcagggaaaaaagggggcaaattcctccttcctctacttcttgttctattcaggccctcagatgactggatgatgcctacccacactgggagggcaatccactttaccgaatccactgactaagatgctaatcttatccagaaacacttttataggcgcatccagaaataagattcaatctcagcaccccttggcccagtcaagtcgatagattaaattagccatcacacttttgtagcagagactgtcagtgctctgccagatctcttaaactttcagtgggttctgtcttacatccaactgccagtatcttcatctctgtatctcaaatccaaattgtgcaaagtcttagttcctaagcagaacagacaagaaatgtcagataattaatacccctagaagtagccctcaactaaaatctcatgagagttgatgtactcaccattctctccccttgggttgaataattctgcaacaaatggtttgattcacatccctcgttacctaccttcccattaatgaatgacttctctatactttcagttatctattgatatataatgaaccacccccaaatcaaaccacttagtgagttaaaatgacagcaatatttattatgtcatgaatctgtgatatgtacagatttagaaagtacagcttgtctctgttctacttgatgtcaggtggagcagcttcaaggttagggctgaaccttctttcactctcctgttggtacctagtccagggagaacttgaatatgtgggggcctaagagagctttgtctctattggtctctccaaatgggctctccagcaaggctacttgaaggtacctggacttcttatatgtcagttcagggctctgacggtttgtgtcccagaagagagtaccagcaaaaatcatgatgtggtatcatttttgttgcattctattcatgagactgagtcatcaatccttagccaaggaaaaaggaatagaatttggaagcaatgtcaaagaacttggaaatgttttaaaactgccacatctttatttcttgcacttgcactcaaatgctttttttttcagggctagcttttgcaggaagccaaactaaaaaaattcccaagctgatttctcctgactgaatcctttgcctgaattttacagttacgttccaaagcacctactgtacaacttcaactgcacattcaacaaaaggcaccttaaattaaacatgcccagagctgaactcattattccaagccccacaccatacacaaacaaaataaaaggcagctgtttttttcatgctccccaaatcagtgaaaggcaggaccactcactcaattcaaacaaaaaacctgagctttatccttgaatcttctttctgtcaactttgctggcactctccaaattctattatttctgagtgctaactagttctgaaccaggccactgccctttgccacttggaatactgagattgttttctaactggccttcgggctcaggaagccaacctccaatttattttcttctcatagcagcccaaataagcttcttaaattgtaaaaatgatcctgccttttacaatgtaaatccttcaatgaatccccattgctctttaaatgaagtccaaactttttagcagaattttagtaattattatacagtttttaatatttttatatttccattgactttctcagcagggactattctctatcttattcatctttgccttcctgaatatatacacacaaacacatatatatgtatgtttacaaatatataagtatatatactcatatatgtacatttattaaacaaatatgtaagtacatatattgttataaatataaatatataaatacatatatttgttataaatacaaatatataaatacatatatgtacagataagcatatgtacttttatatttgttcattattacttttattgttaatagtgtctgctatactccatttattcaaattttgagttaaaatttatctcctatataaatatatgtacttatatatttgtttaataagtaaattgaacaataatatccaaaaccctattagtaggtattcaaaaagagcaaaatacatacgtttgtgtctatgaaattacccataatttcacggcaggtgaatgggagaattcttggattagaagactggaagaacgcttgaagttgaagagagaagatcttacacatgaaggagttataaagaatgacaacagagcagtcaaagcccaggctaactagtcattctatgaagataagttagataagttaatttggagttgctgctcagccacttaaagctctacattttcttatctacagatctggaatgtaacaattttcataacatttcagttttatggagtcataaaaatcaaagaagattaaataggtaatagttactttgaaaaaatataaaatgttacacagttgcataatagtgtgattatcttttgattaacataatgaaattcaataataataacaagatccacaatatcaaaatcatagtaaaatgaatcaggcttactctacatactgatgctgaatttttgtactcaccagaggacatagaatgttaggaaggctcataatcagaactcataatgaatactctcagatttttacagctgtaaagcaaatcagcaaaacatttagtggcttcaaacaatattggtttattacatctcatgattttgtgggttaattgggcacctctttgttcatcctcctgctccatgtgttataactggaatcactcatgttgcagcattaatctgggagctaaactggggctggaacatccaaaatggctaagctcttatctcccggaatctttctctacatgcctttcatctaattcaagcttcttggaaattgaagtctggattttaagaggaagcattccagaaggacctgccccacatgcaagtgtataaaaagcttctgcttgcatcatgtttgctaatatcctattggtcaaagcaagttacacagataatgcgtaggggaccacacaagagcctgagggataaaaggttgattgattgctacagatcagcagtctaccacagcctaagagctacccatctaaagaggacgatgtagaggttgagtttgagctctgaagccaaactacttgtgttaaaatcctgtgtaattattggtaagatttttacatttccaagtctgttttgctatcttttaagcaaggaggcttaaagagacggtccatgcaaattaatggaacagagtctgaaacggttttaggcattcatgttcattattactttttattattaatagtgtctgctatactccatttgttcaaattttgaattaaaatttatctcatatcaattacagaaaatgacaatgcatgcctttctactacaaatggtaactttctatatttttgaggagactgtagggtgagaggcctgtaactacataaataaatttggtgtatgacttggtcagaagtgatgaagcagtgcctcatttatatttgtgtttaattgcaggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaagcctcatctttccaaacttaaccatttgtgtatgcgtcaaatcaagcctgcacgcgtgcgtgcatgtgtgtgtgtattttccccaaatggtgatgatgagcagtgctttgcatgaaactagattttatcaattt

SEQ ID NO: 391 - DNA, 109070 bp, Homo sapiens; identical to SEQ ID NO: 390

SEQ ID NO: 392 - DNA, 16476 bp, Homo sapiens
tcaaattccagctcaagtttatttttaaggattagttgagcaagtttggagttggaagtgagagaatcgtgtttaaaggaaagggtaggtcatccacagaacagctttcagtcattacaaaaaaaaaatacttcttgcttttatattaccatcttcccccattaggcctacctgcatactgtgcttcatcaaatctaagatcacctcacaactataccattattttaggcaccactaaaagacagtgtattgctaacaaaactatgataaaccattgataatatatccagatttcagagatgttacagtgcatcttagttgatgaaacaaaaatatacaaaacatgagacacagtaaaaatgataagtaccacctcattataccttttcacaagcaaatagtggccaaagatgtgaacggccagacacggtagccgacatatgtaatcccagatactctggaggctgaggcagaggatcacttgagctcaggagtttgagaccggcttgggcaatatagtaagaccccacagaaaaatgtaaagccaggtgtgatggcacacacctgtagttccagctactggggaggctgaggcaggagggatggcttgaacccaggaactggaggatgcagtgagctatgatcacaccactggactccagcctgggtgatggagtgggacagtgtctctttaaaaaatgtgggccaggtgcagtggctcgcacctgtcatccaagcactttgggaggctgaggtgggaggatcacttgagcctaggagttaagagaccagcctgggcaacatagactccacacaaaaaatttttttaattagctgggtgtggtggcatgcacctatagtcccagccacatgggaggctgaggtggaaggatcatttgagcccaggagattgaagcggcagtgtgtggtgattgtgcccctgcgctctagcctgggcaacagcgagaccttgtctcaacaacaacaacaacaaaaggctatctattgtgggtacactgcctatggggtagtcctgctccacaaggagcagtttttaaaaaaaaaaagtttaagaagtgttttatgtagcacttttttcatatttacatttactcaccatatggcttcaaaaatcataaacatactcaactaaaattacagatcaccattgtcctcaatgacacaatttttgtatggtgtaccttacctgtaattctatttcctatgggaggatttaagagatatcttaggaacactatttaaagggatttactgaagtgccaaccttgtgaatgattttacctcaaattgttcagtggtaagaaaggtaataaagcatttagttgtgcctttaagtaggctaattttttttgttttgttttgagatggagtctctctctgtcgccaggctggagtgcagtggtgtgatctcagctcactgcaacctttgcctcccgggttcaagcgattctctcgcctcagcttcctgagtagctgggattacaggcgcatgccaccacgtctggctaatttttcttttttttagtagagacagggtttcaccattttggtcaggctggtctcaaactcctgaccttgtgatctgcccacctcagcctcccaaagtgctgggattacaggcgtgagccactgcacccggccttaccaggctaatttttaaaaacatgcgtttttaattaccaggatttacctgataaaactactctttgtcaaggttgtaggacttctgaaaagacagaactagctttgttgcgtttcacgaaggacagatcagttcgtctgtataggctataagcaggtaagtagtgcactctattggtgaaggatttctgttgttttggaaagccaactatagctggctgcatggagggaaatccaaaatccagatgacgtggtgtgagtcaatgggatgagaaacactggtattttctttacaatttcattttacaaagagcacattaaactaaaattttatgaattatgacttaatctaatagttcaacagcagactcaagaaaagcacagatgtgattctaacagaagactactcatataaacaggtttaatgcaacatggaatgcaaaagattagaaccattaaaatatttaattcttcaactttaaaaaattaaataaaatcaaaataggataatgaccagaatagtgccattataatcacatcaaaaagcttccattaacattttatgaatttggcaatctagtacaatacattaagtattgtgtttcactcaattttgtgatactccatttttgaaaaaacttagaggcttcagatacccatgaaaagaaaaaaatcagggtagaaacacataggctgaggtttgctaattcactgtttacagaggaccttagatgtcccactataattgctcttaggtatttttaacaaatgaatagtcataattcacagaaaagacaagtggtactttttatctacatagactatactatataaactttcagtaaaacatttaaattgttttacttttaatcttgtcaagtaattttcatttcttctacttcaaaaggttgaccaggttgtttgcctgtattgggatcaacgaatgttggactatactatgtttagttataataactaatttatccaccctgacttaatatgtgggaaacaatacacccctaagtgtattgagatgtttctttgaaacaaaaatatttaattttatgcatgtgataaacagccttattcaatgtatactttttttaaatgagcaacacagatagcagacatataactccttattacccatactcttgactaccaagaaaggaagccaaacttttagaaaaatacaatgcaagaaaagattcaagttaaaaatatattcctttggttaaaaatcatcccctttataatattcatttgtaatctaaattcacagcatgtcccaccagcccaaagtaatcttctaaatgtcattatacttgtagtattacaatgttttttcagtccagtatttatggaggtcactcggctgcagcaacaaaatatttcaactctaggaagagtgtagccttgtagcattagcccctttgacaattttcttacaagatttttactttagaaacctccgacacatgtagttttcttcagatacagtatatccaaactttttatagaaaccaacattttgtggtagacattcaagggtaatcttgtaacagttcagtttcttgcttagcaaagtaagggttgataataacctgaaatttaaaaagggggtagggtgaggagatagcatttattaataaaaattgattctagtaacaatatgaattaatgttataaaacttaagtttccttagaaacaggtttagattatggcttttcccactgcattcatgtaagttgataagcatttaaatcaccaaagcatttttacttagagtcaaatatacttttatctagtaatctccagctcactaataaacaggacaaatacaaaactcaccctaagccctctttaaaaatgaaatttaaggctaggtgcagtgactcatacctgtaatcctagcactctgggaagccgaggcaggcgatcgctagagcccaggggtttgacaccagcctgggaaacacggcaaaaccccatctctacaaaatataaaaattagtagggcatgatggcacatgcctaaagtcgcagctactccagaggctgaggggggaagatcacctgagcccagagaggtcaaggctgcggtgagtagtgattgtgccactgcactccagcctgggcaacagagtgagtctctgtcttgaaaaagaaaaacgaattttaagatgcatgttaacactaaaaactcaacctttaaaaaaaaaaatgaccaaaattattttgtaaaaattctttatttaaatctatttaaacaacttcggagcagtcgacatacccacataaaatgagtacataatagctttgctctttaatcatttttaaagctactttaatatttgtgaaggtgtgtatcagattaactcaagattggtctaattaatatgaagtggaaacaaagcaagtctacatctatacaaaatttcttaatgaatccaaacccagtattaaagtgtggatctaagtgccttagaggataaaaactataaaagatatacaaacttgaagggtctgcccatgtttgaacagactaaaaaatcctatttttaaaaaaaacaaaagaccttgactgaagtatgcctggctggttgcagtggctcatgcctgtaattccagcactttaggaggccaaggatcacttgagtccagaagttcgagactagccaaagcaacatagcaaaaccctatctctataaaaaattagctgggtgcagcggcatgcacctgtagtcccagctacttgggaggctgaggcgagaggctcacttgagccccagaaattcaaggctgcagtgagctgtgatcgtaccactgtatactccagcctgggcaacagaaagagatcccatctcttaaaaaaaaaaaaaaaaaaaaaaaaaacataaattatatagactagaacacaagaaatcggtctgttttgttcactgaggtattccaaatacctagaatagcatctggtacataagcaggtatttaatatttgttaattccttaaaactcagaagagttagtgttaaaaagcaagttcttgggccaggcacagtggctcccacctgtaatcccagcactttgggaggccaaggcaggagcactgtttgagaccagcctgagcaacatgatgaggccccatctctacaaatttttaaaaattagccaggtgtggcgtgtacctgtagtcccagctaattggggggctgaagaggattgcttgagcccaggaggctgaggctgcagtgagctgagattgagccactgcacctcagcctgggtgacagagctgtcaaaaacagaccctgtctcaaaaactaaaaattataataaataagaactacaagttcttataaaatggcaataaatcaataccacttatttatatttattttaaatgatttagatatatacagtgaaggctgtttcagtatgtatttctacaacttatgagaatgagagatcacagaatattctgtaatagttgaacatttcctttgtttttaaatatgacagagaagctgaggcaaatccgattagcccaaaagtttatctcctactaggacgagagcattactataaaaagttagtaatttaaagatgttactgtctgtaaagaagtatgcttccaattttcaaactttaaggcaaaatatgtataataatactttatttcttcatgaaattcagtctaaactattagagtgagaataagttcagaattaatgaagccaaaaagaacttcaaacaagtatcttgttaagaaactaaattggaacaaaatttatccagggttaccttgtttctgcctacttacaatttgccaagctgctttcctctgcattcatcactaacaacaacatcttctactcttcctctctgaaaatatttacaatgtttaaaggagtaagcatttacttttgtttttagctaaaacgagttggtaagaatttactgataataagtagtatattttgtaaacttgaacttaacagaaatcaaatgcaaaaaatattatacagtgaaggctgtttcagtatgtatttctacaacttatgagaaggagagatcatagaatattctgtaatagctgaacatttcctttgtttttaaatatgacagagaagctggggcaaatctgattagcccaaaagtttgtttcctactagtatgagagtactactattaaaagttaataatttaaagatgtttttacttattagaggaaatagtatgagtcaagttgtgacctaaacttgttttggctatgtccccaaccttcccaccccattgtctttaaacaaatatcaggatcaacatcaccaaaatgtaaccttttcatgaatatatccatcattctactccttgcttactagcaagttattttagatatccaaataaaattaatgtctagtacagaaaccccaccgaaattcctaagtgtgacagaacacatcccaagtgttcctaccttattctcattgaattaaggttttctctccctctttttttatttactattttatgtgagttattgagggatgaaagggcactacatgcattagatgtatcataattagaacggaataatctgaaccctttaccatgtggaaacaaatttatgctaacgtggtatattcagagttgttttttttaaaagagtaacattagggattttgtgcattactgctaagttgtttggtttctctatgcctataccaaattgatccaccttacagaacaattttagcatacaattcatactgttatacattttctttcttaaagctctcagaacacactgggaaaagggatttctaagaggcactgaaaatcaatgagaaaacagatttgtctaatggaaactcaaagtcagttgtgctagaaaacagctgtccattttatttataagcagcacataccttagcacaggaatggatgaatttatgttctataatcagagttgccgtagcaacaatctgtcctagagtcacatcttctacaactgtaacataataatccccagatttcttcatatgctcaaaagattctgtggaaattggataacaaagtgttacatagtagacattcaattttatggggagccagaaaaatattaggattagctgacttaattactaaatgtttaaagctgttttaccatagtaatttaccttccatttctaaagaaaatattaccaagtagttgaaatatcagcaattagtatcaattggaatataacctacacattcaaaatatctgctagcaaaataaagactaatatagctattttagatgaacaacacttaaaatacaagtaaatggctgatgttgccacttccatgactaatgaaaacttcaatttcttcatttactttaaatagatctctttaacttttatactcaatagatattcaaatataacctttgcacattttaacaagagcatgtttacatggctcaattctagaatttttagtcttttgctttcaaaatatttttacaaaatatattttaattttccctttgtgatggaaagtgttttgtgataacatgacttgctcttgtttgctttgagagcaccttgcaaggaagtaaaaacatatctgtttccaagtaacttttccaagtcacatagcaaataggtgcaaagatacttcccctcaaatggattttcagtactattgctgaaataacatggtttctcatctaattcatgtgcatgcaaagaaaaattcaggaataaaaattgaggctaatagtctctcatattgttaatttctatggtctcattccagatagagatctaaaatgggaaaaagaaattcagtgaatgaaaataaacaatgagaatcagaatgatggtcctcattctcaggagggtcaaatagaattcaatacaaaattccctattataaggaaatgaagaattgtaattcctcagctattaaatattactaaatatttagtaatgataataatacttcatttcctttataacaggaaaaagcagtggtagagcactggacagaattaaggttttattcctcaccgtagcaataactacctgtgatcttgggcaagtctttggatctctctaaattcctattttctcctatgtctaaaagaagaggggcaggggacgggtggactaactcttaagatgcctgctaaccttaaacttcaatacaaataaaccccaaaataaatttaaagcgtatagtcttgcttttttgatttggtaatgaaatttctgtaaataaccacagtaagggaaatactacaataaaaaaacgaaaaacctctagagctaacacctaggtcctatggtacaataattatctaataaagtagtcagatagtttgcaaaaacaaagttactggtacatttggattctagaacaactcagccacattaaacatttgtataaaacagctaatttgttctttgaataatttccagctatttgaacaaaaacagaagtgggcactgaacagctctaaacaaaaatgaaatcatgtttccctttatttcaggaaaaagaggttatagtacttactcataaattgttcagggctgacaactccagtctctgttagctgacccaataccttaaaaaaacctagttttgaaaaacagatttcaaattacgagaatagcaaaaggaagacagtatgaaaataagcaatatattaagcaggtgggcttacaggcaattattttttcagaactttctataatcttttaattattagaataaagtgaaccctattcttctataatcactacatataacaaaaataacaggttttaccagtgcttctgcctgcataagatgttttaaatagtgctgaccttaatatccagtatttatagacccagaacatacattcttcaatgtattatattttacattaagttcaatgcaaagggtgccagattttcccaaatatgtgatttggttttacttaaaggtgcaacatggctaaatacaatattcgtaaattaaagtataagtaacactgttgagattacactctttaaaattgtaatttctagtgaatttcattagtgttaccggaaattgatgtgaacagtgcacctggaattttgaaaatcttaactttcctacactcaataattaggccaaaattaggcccttcaggctgtctagcaaagagataattgtgaaaaggacaaagttgacttttaattaccaaagtttaaggaagttaacttggagaatttagatgttaaaaaagaaataactgtataaaaaccctttcaatttatccaaggaaaattatttccaccttcattccccaaccagcttcttaagatccctccttatgtgtcatcatacatgataatttaatttttgtttatgagaaatctttttggcttaattaggaaggagtgatgttgtatttaagtcattttaaatatttcacagtaatatttggtcttagccatgacacacactcattggtattgagtgtccatcactttaaaaactaagtattatacaaaaaatagtccaaaagtcaaatatttaaaaaaaattatctgcatcataatgtttagagaaaaatggaaggctaactctaattttacacaggattttgtacattacctctatttaagtcagcagtacaaagaggcctcaaaaccaagccttctccaggatgtgttggggaaatggctggagaaaatgtagctgtattctgactccagtccacttctttgagtagacttgggtcaaacataggagtttcatcaggtttcatttttctagtaaggtctaaaataaaaatttgaatattaagtcactttatttaatagaaggaaaattatgattgttgagaaagttaatataaattaatgcaattagaagcattctttagcacatatgcgagatattttactgcaacccagcctgaatctaacattaaattccacaactacagataaatagaaaaatcatgcctactatcagataaaaaaatggctaagtgactaaattagtaagttttaaactataaaatcccatttattatcaagtctttttttttttttttttttcagacagtctcactctgttgcccaggctggagtgcagaggcgtgatcccggctcactgcaacctctgccttctgggttcaagtgattctcctctttcagcctcctgagtatctgggattataggcacgtgacaccacgcccggctaatttttttgtatttttaatagagacgggatttcgccgtgttagccaggctggtctcaaactcccgacctcaggtgatctgcccgcctcggcctcccaaagtgctgggattacaggcgtgagccactgcgcccggctattatcaggtcttttaaaacatgtttttcctctgggttggtgctactaaatgaatagctgacttttcatgggctcttaaattttttacattatgttcttggattttattattgagccaagaaggcatctgtttcaacaggaaattgcaaggggaaaaaaattttttttaaaaaagtaatctcttagtcttacttgccaataaagaaaactttcagctgtgcacggtggctcacacctgtaataccaacactttgggaggccgaggtgggcagatcacctgaggtcgggagttcgagaccagcctgaccaacatggagaaacccccatctctactaaaaatacaaaattagtcgggcgtggtggcgcatgcctgtaatcccagctactcgggaggctgaggcaggagaatcgcctcagaacctgggaggcagaggttgtggtgagttgagattgcgccattgcactccagcctgggcaatgtaagagtgaaattccctctcaaaaaacttactgggcatgtagcctttttttttttttgagatggagtttcgctcttattgcccaggctggagtgcaatgatgtgatcttggctcaccacaacctccgcctcccaggtttaagcaattctcctgcctcagccttctgagtagctgggattacaggcacctgccaccacgcccagctagttttttttgtatttttagtagagacggagtttcgccatgtcagccaggctggtctcaaattcctgacctcgggtgattcgcctgcctcagcctcccaaagtgctgggattacaggtgtgagccaccatgtctagccacatgtagctttttttttttttttcaatgaaccatgaatagaagaaaattgatgaacaggctcaaattaatttttttttttggcattctcagaaatactttaccttggctatgctagatatacactgcaggattttgttttcacagcagattttctaaaaatctgtggtatggaccaggcatggtggctcgtgcctttaatcccagcactttgagaggcagaggcaggtagatcaccagaggtcaggaggtcaagaccggcctgaccaacatggcgaaaccctgtctctactacaaatacaaaattagccaggtgtggtggtggccacctgtaatcccagctacttgggaggctgaggcaggagaatcacttgaacccaggaggtggaggctgcagtgagctgagatcacaccattgcgttccagcctgggcaacaagagtgaaactccgtctcaaaaaaattaaattaaaattaaactgtatagtgtttctcagttgcatctaagcagcttaaaaatagctggtgtttttcatgctattgaaaagtgatcatgatatttccccctcttttttgaacatttagaaatgagcaggttctcactagttgtaatgttttaaaactgagactaaataacagagaagtaacgataggaaggatgaaaaacaaatcatacaaagcataaaactggggccagggggcttctgtgcagcacagaattgctaaaagaaacagatgcttcccaacaattaaaagttgagtattccttatccaaaatgcttgggaccagaaatgtttcaggttttggattttttttttttttttttttttttttttttttcagatttggggatatttgcatatacataatgagatatcttggggatgggacccaagtcaaaattcatttgtgtttcatatacatcttatacagatagcacaaatattttacacaatattttaaataattttgtgcatggaaaagtttttgtacattataccagatgtggaattttccacttgtggcatcatgttggccctcaataaagtttcaaattttggagtgttttggatttttggattagagatccaaaaaaagcagtccccaacttatttctatatccagttaaagaaaccatattttaatgagagaacaatttgcccaataacctaacccccaattgttccttatttcataagtcacagtatgctttagggcaaatattcttaacttttccttaaagatggataataagtttctgcctgtataatcctatgtaactatataagcaatgctgcaatatactagttatgggaaggtagtgtgatgtgatgtaacaacagaagttaacacttgctcagcacttcttatgtgccagactgttgaaagagctttactaattcatttatttcaaccatcctacaggttaggagtggttattatctacattttaacagatgagaaaatgttaagtaacttgcccaaggtcacaaaattagcggagccaggatttaaacctaggcatagaaagagcatgagctttggattcatacctggtgttcaaatgtcaactgtgtgatatgtactacggtaattaagcttttagaatctagtttcctcatttgtaaaatggagatgaaattactgggagaattaaatgcattactgtatgcagtcatgcacttagcagtgcctggaatactgcaagtacttaataagatatatgctagttagcaataaatttaaaattaaagtttataaattcttgttcatttttttttacctttaattcatgaatcaggcactgtgctggttacaggaactacaaaaagaatgacaggctcttacgtttatgttataccaaaagttagcattcttgggtagaaaagaacgtagtttataatgtagactgctgagaggtccccccagccacacacacacaaaatgattcaaattatgctgcatacactatacccagttctaacaatattaaggaaaatatagaaattgtgatgatcaagcagtcatttcaaatttaacaagtttaatagccattcaaaataggttttttgttttgttttattgttttgagacagggttttactctgttgcccaggctggagtgcagtggtgcaatcatagctcactgcagcctcaaactcctgggctcaagtgatcctcctacctcagcttcccacatcagcctccagagtagttgtgactacaggctcataccaccacgcctggctaatttttgtatttttagtagagatggggctttgccatgttggaaaggctggtcttgaactcctgacctcaagtgatcctccagcctcagcctcccaaagttctggaattacaagtgtgaaccagcatgctcagccaaaacaagtttttaatagatgaaattgagtccacgtgttttagtgttttgtctaaattggacccttgaggtttttgtgtgtaatctcatctgaatggtaggtagcaacattgtttttcaggtatgtagataaacaggctaagtattaataaagtgaaatgtgtacagtattaaaaatgtaaattcctcgaggcagcacactatttaaacattttggtcttgctattaaacatatagttgtaaatacaaagttcaaagaaaactcaaaagagaatttaaatcaaccttaaccacatttaactagattcctttttcctataaagttgtctgtgtttacaataaaaatgtggtctagaaaacatgaaaaatagggttaataattttcatgagagggaagaagtatacaggaaaacaactaggattatgaagcccttaaataatgaattttaaccaggaaatactaatattttcttgtacttttctttgatgagacagtccttttccacgaatgatcataaaaataaataatattggctaacacttattgaaaactttctatatgttaactcttaaaaatacaatgaacgatgtatcattattatcccaattttacagataaggaagcaggcacagtaacttgctcaaggttagagtgccaataagaacagagtgaggattcaaaatgaggcaacagggccagcttcagaagcccctgacctgtgccgttacacagggccctgcacttaagtttgataccctgctgccactgttttgaagttcttaattttttaacaaggaaccctgcattttaatttggattaccacagattacgtagccagtcctgctaggtagtatgacttcagactctgctcttaaccattacactgaagatgcactagagtagataaattccctatcttactgttgtacaagggttaaaaattaagtcataagcagcacttagaacctacatttggaaaatgggaatcagactagtcaaaatacattaaacaaagcattacagattgaaataagaatctattaaccaggcaatcagaaattaacatcaaaaatttttttatgagctattctacaaaacagagccatactgaaggcccactttagctcactctgtcctcaaaccgtaaaattctgctggtgcccaactaaggtactgggcaaagtgaagcaagatatgacttgaaacctggttccaagggggtttagaacataattaaataagtaattttatataaataatcttttagcatcttcaggtgcccagatattgcaaaactaggaaatttctgcgaataaaattgcacagttgtgtgaagcggaatctcatcatatcattaggttctttaaagtttttagatgaactttaaacactaatcctccttaagtattcctcagaaccttttctgattaactgctaaattagcaggcgtttagaagacccgtttaagcctaaccctagcccaataatgcctagtgaatgaataacgaataagacttacctgtaggtcacatttcagaaaatccagaaggacaaaaaaaaaaaaaaaaaaaaaaattcccaaactgccacaatatcgcggaaagcatacaccaaattcatttttactagtcatcacatcagttgaatattttttcactcaattgaatattttttaaacaaaacttcaactatttggcgtctgagcctctgtatcaggttggaatacgaatggggagagaggctgctgctagaagcaaccaacggagagcaacaagtaatagacaccggagatgaagattttaaaagtcgatctacaaattttaaaaaatacaatctaaggccaaatctaaaccagcctatgtatttctcaagagctcctggggaaccttctaagtacaggtgaatgggggaggggcggacttcggattcctttatattcattttataacaatttcgataacaagaatccattctgaatctattccgttaaagatttttaacacacctggccatatttattaaattgtgtaactgcatgaatgttcaaaagtattttctgatagtttgacctttacaatctaggcgttattcccagtctaccgatgaggaagctggagcacctggaactcccaagacttgccccttaggtaacacagcaagtaagtgacttggggctagaatcctcgttttcgcatcttgagctcgattaccatcctcaacagaccccaatctttacatcatcataccatacagctagcgctctctcccctatttagcaaatcctgcctaaattaatttcttaagatccattctaggattcgttcatgagggattatcctaacaaaacgaatcctataatcgcccgttcaattttgtatgaaaattttaaattagtttggcttacataaacatcagctcccgcaacagaaatcacagtacagtactcggtatttctaggggtaggagcctaggaaaaagagacaaagaatgtccctctgtaccctggggaaagcgccgacctactcggtgcggaggtggtcttcggagcagctgcctcaatggctccgaccaccgtgggatgcgcccgggaatgggagaagagaaggggcctgggacgttcgtgcccattcaaaaccgatggctgcagagagcgcgaccaactgtctcatttcccacgccaaagtctggggagcgaagttccgaccccagtcccagttccagccctgccaggccaagaccagcgtatggccggaccgctggccatcatccttaacctctgctccaggcgcgcgtgcgttcaacttcctgggaaccgcgctccacaccatgtgcacccagctggcgaggattaacgcccagctcctccacacaacacccccgggggcctggccggggcaccagacacacctgttagataaacctgagggcaggcccgccccagcccccaggacacacggtcctgctctcgcgccccggccccggtccctcctcacccgtagaggccctgcggtcggcgctcctagccaggcgcgtcggactctcccccaccagtgtgcacagcaccggatccggatccggcttcagcgccagccccacctcctcctccaccgcccgcgccacagttgggaaccgcggcccagacgtggcagcgccaacgcctccacctcgcctctgccccctcacgcagggccgcgcgcaggcgagcggaggcggaggccaaggcgccacccgccc

SEQ ID NO: 393 - DNA, 82391 bp, Homo sapiens
acaacgcgctccctgcggggcgggcggcaacctccatgcggcctcgtccacgctcagcaccggggaagccgaggcggagaagccgcgcgcgcctcagaagctcccggacgcccaggtacgtgggagcactccacagatggcgcaagtacggttgggccaggcggttgcggccccgtcgcgccgcggcctctgtgacgcacggcgaggcctcccgggctgctgcgcggcgcagcgggggcggggcgagcgcgtgagggcggggcggtggggggggggggcggagcgagaggggcggagccggcagaggccccgccccggggccggaggagcgaggacgctacggagcaggcgcgtctcgctgccgccgctgccgccgccgccgctcgctcttctgtggagccgccgccgccgccgccgccatttgcacggggaccccagtgacaggggctcggcggaggggcggaggggcggagggagggggggagggcccgcggagcccccgagggcgggagcgacgccgccggcgccggccgggctccctgcgcgaccgcgccgcccgcggcgggccccgagcagcagcagcagcagcagcggcagcagcggcagcagcagcagcagccgaggccgggcgtgcgcctgaggcggcggcggcggcggccctgcgggcggccgggaggggcgggggcagcggccgccgccgtttgatggatccgaggatcgcctggtttcagccagagcagctcggaccgtccaacagtctgtggatgcagatctgggagacgacccaggggctgaggaacctctacttcaaccaccactgtcacagcagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtggggtgagtgctggctctgcggcccgatggcctggccggtgcgaatgcgcagccgggcacacgcccacagaggggggttgtgagggtctaggagcggccacccccacggcctgccttcgctgctgttgcacgggggtgctgctggccatccccaaccccccagtcgttcacacctttccccaagcctccttagccgtccacaccctccgtctcctgtcctcccttagtcgtccacaccttcctcccctccctcttaaccgtccacaccttccccaggcccccccctttatccattcactctcctcccatcccccttagttaaacacatctacccttgaccaccaccccgcctccagccctccacacctttttccccatcatcacaactcaagatgagaccgcttagcacgggcctatcattcattccctgagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctcccttcagaagagtccctgtgctggaataggtcactgaatcttatttgttttgtaaaacaaagcttttgggtctcgtgggtgtgtgtgtgtgtgtgtgtgtgtgtgtgtgtgtgtgtgtagcttgagtatggagaaccggctttcaaattgcttttcatttttcaggttgtgttttacattgagggctttagcatgcaaatgaaattaccaattagtaatcccatgtgaaccttttcctggatttattcattcagatctgccctgctttggctgagagagagagttctgtgtacctttttgaaggtctggataaaatgagttggtgggttccatctgcttccagtgggctggtgtctgctctatgctactattacaactcctaccttttgtggaaaatgcagtcaagcgttctaggactggtgctgtggtacatgtcaaacctgccctcacattccagaaagggaacccttttagggttgagtcctctgttgctaagcttcaagggtgctctccatggtcatcacgttttattaaaggcttgtggttccatcctgttagcatttccaagtctacgcgtaaacctgtggtttagtgacaagcaaattgatgttgagggtttctggtagtttcatttcacaggagtaagctccagttaggtaatcactgtcaacgaaaaccttgaagttccttaattgcattttactgaagcctctttgcatgtgtctagcaaaagatataagtccaagatgcttattttttttttgataaattagaaattgtcctctcctctacttgctatttaatgcagaagatactctaaaaggttcatatttatacttagaagcaagatgttcttgttcctgattcaaatatattgccctcaaagggattaggagaggaattttcatttcccggagggattactgtttaaaaactggttgtaaacctctttaaaaactgcttatcacttcaccagattttccattcttttgcctcctcccttagaggatgtcagcagttaattttttttttaaattaaaaaaagttcaattctgagacctcctagtttcaaaaaatacattaaacaattcccaagagtgttaagagtgtctgggtgcttagaaattcttgctttgattcatgtattctgattttttttttttttttgagacggagtttcgctcttgttgcccaggctggagtgcagtggctcgatctcagctcaccgcaacctctgcctcccaggttcaagcgattctgctgcctcagcctcccgagtagctgggattacaggcgcttgccaccacgcctggctaattttttatttttagtagagacggggtttcttcatgttggtcaggctggtctcgaactcctgacctcaggtgatctgcccgtcttggcctcccaaaggactgggattacaggcatgagccaccgtgcccggcctcattatcctgatttcttttttttcttttgagactgggtctcactctgctgcctaggctggagtggagtgacgtgatcatagctcactgtatcctctaactcttgggctcaagtgatcctcctgccttagcttcctggagtagctgggactacaggcacatgtcaccacacctgcctaatttttttatttttactttttgtagagatggggcctccatttgttgcctaggctggtcttcaaccggcctcaagcagtcctcccaccttggcctcacagagtgctgggattataggcatgagccaccattctcgccagtatccttatttcttaactttagaaagtttttctatttttaatataggtatttaaaaaaatctgaattcagagtgcacctcgatgttatgctgttctgagattaaatatactaaaactgttaccattgttttctgaattcttaagatgtgactgatagttagctaataggttaacacattgtggtggttcttggcctctgaactgatagtccagatggggagaggagaccagaaagcatgtgaaaatggactagaaccatgggacagctatatagtctctcgcagctgtcttttgtgttctctgcttccaccaaattggttgatttatttagaatgctgacctcttgcattgcctaagtccttgatgtttttggtttctcctctgaactctcaaaggtactcacttcatgctcttggtatagcccacttatgtttaactttccttttattatgtgttccctcttacacatgacatggacatttctttaatatgtagagtaagatattggatttcatcctaaagtcttcaaaataaaactcttgagctcatcatctcagacttcttcatgtacccacagaccagggattttgtttgctttttaaaacatttttttattttgtgttttattatttttaaattttaatttaattttatggagacagggtctcgctctgttgcccaggctggagtgcagtggtgtgatctcggctcactgcagcctttgcctgggctcaagccatccacatgccttggcctcccagtgtgctgggattacaggtgtgagccactgtgcctggcctaaatttatttttttaattttttttgagacagggtcttgctctgtcgctcaggctggagtgcagtgtcataatcatgggtcacagcagccttggcctcccaggctgaagtgaacttcccacctcagcctcctgagtagttgggactacaggcgagtgccaccatgcctggctcattttggttttttttgtaaagatggggtcttgtcatgttgcccatgaaggtctccaactcctggtccaagtgatcctcccgcctccgcctagcaaaatgttgggattacaggtgtgagccaccatgcctggccttatttatttatttaattatgaatgaatgaatgaattaatgagagggagtcttgctctcttgcccaggctggagtgtggtggcacaatcttggcccactgcaacctccgtctcccaggttcgagcaattctcctgcctcagcctcccgagtaactgggattacaggcgcccgccaccatgcccaggtaatttttgtatttttagtagagatggggtctcaccatgttggccagactggtttcgaacttctgacctcaagtgatctgcccaccttggcttcccaaagtgtcaggattacaggcatgagccaccatgcctggcctggccttttatgttttaagttgcttccactgattctcttgggctttgctcccctccagaactggccatggtttaggatgctgtccacctgctgctgcttgtccatgaaaacgagccataaacccttttcttttgaaagacttaattgtttatcactatggagaaagaggggatggcaagaagtagcaaatacagggaatttgcagaacttggtcttgagccctgggtccagaaacttcttctggaaggtgcttggtgtttgtccaagctcatgataggtttctgttggctgtactgccagatctgtagatgcttttttaaggcttggatgacttgttcaaaacaatgttttggagtacaaatttggctgtggggacatcaagaccttgttgggaaacttgggtttaaggtacaatttcttaaactaggatggtgggaatggggatgtgaagggagaatgaatgtgagaggtattacagggtaaggatggagatgattcagattccttaagtggatttaataatcacactgtagctttgaacttgagtgactggggaaatatttgtggtgtttttggaaataagggccagaaggactattggtttgggtaagaagatagtagggggatgtataggtggacctgctagtggggagctgagatttggagggctgagatgtagtgctcttcactgccgtagggcagtatcctcttgtatgtgccatcctctagtgcccattgttcatcatgtcatagtaagcccaagatgttcatgccttttttcagcactgcattagggcttatatctgcttctctttctctctctctctcgctctcgctccctccctctctctctctttctgttttttttttttttttagacggagtttcacttgtgttgcccaggttggagtgcagtggcgcgatcttggctcattgcaacctctgactcccgggttcaagcaattctcctgcctcagcctcccaagtagctgggattacaggcatgtgccaccatgcctaattttgtatctttagtagagatggggtttctccatgttggtcaggctggtgtcaaactcccaacatcaggtgatctacctgcctcggccgcccaaagtgctgggattacaggcatgagccaccgcgcccggcctctctctgcttatttctacacagtgttaccaatgagattggtgttactgctgggctccaaagcaatcagacagattaaagtagattgaatatgaaagaatttagaggcctttttccaagtgatttgtgctctatttaatttctgtgcatttgcagatatagcccacagtaattcttagtgaactagaaccttcaggttattgaattttactgatttgggtactgacatgcgcttttaagaagacattaggttttctatagtgtagattgtacactaacaatataattcatatttaagaatgtctcaaaatttagtatactgtgttcaactaacttaactttctttgttttttttgttttgttttgtttttgttttttgagacggagtcttgctatgccacccaggctggagtgcagtggcgtgatcttggcttactgcaacttcaacactcctgggttcaagtgattttcctgcctcagcctcctgagtagctgggattacaggcacccgccaccacaccggctaatttttgtatttttagtagagacggggtttcgccgtgttggccaggctggtcttggactcctgactcaaatgatctgcctgccttggcctcccacagtgctaggattacagacatgagccactgcgcccggccgctaacttaactttcattccacaacttccatcttttatccaaaatctgtgatcattgaatactgtcaccattaatcattggcatttcagtgtttggactttttttttcccccttcgtctttgtggactcttttttaacactcataaagttttaactattgaaaagcaaaggaaacggtgagtgactttttggagtctgtctacccagtggtcacacaaaaggcttactacattacaggaaagataggatgggaaagggatactagaaaattctaagtcaggaacgggggtgtgtattagaaaaattctgatcctggcatgccagatggccttacatctcaatttcttccgtgaaattcctgccaacaaatcatagtgttagaagtacagaagggtccatgggaacagaatttaagggctccgttggtgatacggaactgatcagatggttctcacttgttctcagataacctgtatactgaatatcacaggaagggtatagacgtcatggcagtggttagatattcttgcacctgctgaagctgagaaaattaaagtaattttttttcctgtggaaagtagaaaatcaagcttttgtatgatttcacacagctttctattctctcttttgttgactctgttaagagtaacatttagtggtggaaactatttcaggatcacacccacaacactagagactgtattaatcacttacacacacataggtatagagtaatcttgaaggggctgtaggccaaagataatgcttttttgaagaattagagactagttaccagcacctggtatttgctgtttcctacagagctgactggacagcctagagtctgctgaggaattcagaggatggccagtagaatgttctttccaccccagaatatttggtagggactcagctgctgtggaatgccaaaaaggctttgagtttgtttcactattcttaagattacacgtaattgtttttttgtaagagattatatatattcaagttgaggatggctttgagttagactttccttaatttggaatcacacagcagatgatacatttatttccatctgataagttacttgatgatgtaaaaagacatttgagttaaagatttttgggaaaaaagctgaatgttgagccatttatgttgtgtactggttccctattcacttggacaattttaagtcttaaaacaatcttaaccatgtgcacaagagatttcacatagtatttggtaattaaattaaggaattctagctcaagtcatgctttttgctgaaatagttgtatatatttagtgcggaaacctgtgttttcaaattaatgtaataaaagtttcaataaaatggaagcctttattaccgtgtttcaaatgctatgctaaaccttttccatttgttattatattaacctcctcatacatagccctactaatttttttactttctattttgaaataattacagatttataggaagttgtgaaaaatagtacagagcccatgttcccttcaccaagtttcacctaatggtagtagctcacataacgataatttaatgtcaagaaccaggaaattgtcatcgttgcaatccataagccttttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaaaacatcttggcagtattgaactttctcaatgaaaaatctctaaaattgtgacttgaaaggctttaattttccagtttttctttggttttactcttagcagtaacattttaacttttttttgtctttgaagtaattttcagtgtttcctttacatgttgctttttcttagaaactagttactagcatgaagtagatctttagcctcgttttctaaaaacataaaaaagtaaaactgtggggtttatttcaaaattgagagtcctgtcttttcatatgaggatattttatagtctgttggcttggctatattttagggagtaaacctgtggttagtggtttgttgttggtggtggtaaagttttcttacagtatttttatacctgaataatacctttagactctatagaatagatacttgatcttcaaatctatcctagaataaattgttttatctaaacagctttgtgacctgagaattgggacttagtcccttagttttcccttactggccctttgtagtcactgttttgattttgtgaaagtaacttaactcttagcactgtcaggtattgtacattcctgccaaagcaagaataagaatacataggattgtgttttaattctataattaggtgacttttggctaatttccaggaacttggacttaataaagtactagtgataagtttggaaattttagtgtccttgttctttgaagttattcaccctttactttcttgtttgtttggggtgtttatactactgtccctaaatatagctgaaataaaggaagaaaaataacccctgtaatatcactaccaggatataatttcttttttttttttttttttgagatggagtctcgctctgtcgcccaccatctcggctcactgcaagctctgcctcctgggttcacgccattctcctgcctcatcctcccgagtagctgggactacaggcgcccgccaccacacccggcttattttttgtatttttagtagagacggggtttcactgtgttagccaggatggtcttgatctcctgatcttgtgatccacctgcctcggcctcccaaagtactgggattacaggcatgagccaccgcgcccggcctgatataatttctgttaacagtttgatgtaaatattttttgactttttagtgtttttatatatatatatattttatgtttttcttttatcaatacgcactcttactgtgggaataattttaatgtttttaaagagttgggttttatttgtttattttattttatagaaatggggtctcgccgggtgcgatggctcacgcctgtaatcccagtactttgggaggccaaggcaggagcatcacctgaggtcgggagttcgagaccagcctgaccaacatggataaaccgcctctctactaaaaatacaaaattagccgggcgtggtggcacgtgcctgtaattccagctacttgggaggctgaggcaggagaatcacttgaacccggccggtggaggttgcagtgagcaaagattgtgccattgcactccatcctgggcagcaagagtgaaacttcatctcaaaaaaaataaaaaataaaaaagaaagaaagaaagaaatgggatctcaccattttggctggttttgaacttgtggtctcaagcagtcttcctacctcagcatcccaaagtattgggattacaggtgtgagcccatcctgtttgttgttgttcttttgttgttgttgtttttagatgaagtctccctctgtcacccaggctggagtgcagtggcgctatcttggctcactgcaagccccgccacccaagttcaagcaattttctgcctcagcctcccgagtagctgggattacaggcgcccaccaccatacctggctaatttttgtatttttagtggagacgaggtttcaccatattggccaggctagtcttgagctcctgacctcgtgatccacctgcctcggcctcccaaagtgctgggattacaggtgtgagccactgcgcctggcctgttgttgtttaaataaaagaaatttattctcttacagtcgaggccagaacttagaactggttttcaatctaaattttttttcttctttgggagaagggcatcagaatattgtggatatacttttttgacttaaaaaaaaaggttttactgggctgggcatggtggctcacctgggattaactgcctgtaaccttggcactttgggaggctgaggcaggtggatcgcttgagtccaggagttcaagagcagcttgggtgacatggtgaaactccgtctctaccaaaaaaaaaaaattagccaggcatggtgatggcgtgcccttgaagtcccagctacttgggaggcttagctgggaggatcgcttgagaccaagaggcagaggttgcagtgagctaagttcatgccactgcactccagcctgggtgacagagcgagacctcgtctgaaaaatttttttttttttttactaatatgacaaacatcttttcatttcaaatatatttctataccatttttaatatctcattgcctttagaatgaccttgtattcatagtacatatgtatgtgatattccatttatttattttttttcttttgtctttttttggttatattccattgatttaatgtaccttaatttatcttaccaatttcttgttgaccattttgtttccagtcttttgtttttttaccagacatggattaagctgagcctttgccccagacgacattatttcttttttatcagcaaaatatgcgtgtaatgaaattagaattaaaaggcaaaaaaggttatcctttatttttctacttatttttattgagatagtaattcacataccataaatttaacccttttaaagtgtacagttcagtggttttcatatattagaaggttgtacaaccatcgcaactaattccagaacattttcatcaccccagaaagaaactctgaacccattatcactccccactccctcacacaccctaaccctggcagtcacatatagactctctgtctctgtggatttgtttactctggacctttcatataagtggaatcataacagtttgtggccttttgtgcttggcttctcaaacttatctgtttccaaaggttatctgtgtcgtagcatgtgtcagtacttcattcctttttatggctgaatattttattgcatgtatatgccacattttgtttatccattcacctgtagaaggacatttaggttgtttccattttttggctgttatgaatattactgctgtagacgttcatgtacaagtttttatgtgaacgtgttttcatttttcttgggtatatacttaagtgaggaattcctgggtcttaagttaactctctgtttaacattttgaggaactgccaaattattttttaaagtggctgtgacattttatattctaccagcagtgaatgaaatttccaatttctccacatacttgacagcacttttttttttttttttttttgaggtgaagtcttgctttattgcccaggctggagtgcagtagcatgatcttggctcactgcaacctccacctcccaggttcaagcaattcttgtatctctcagcctcccgagtagctgggattacaggcgcatgtcaccatgcctggctaatttttgtattttttatagagacagggttttgccatgttggtcaggctggtcttgaactcctgatttcaagtgatccacctgccttagcctcccagagttctgggattacaggcgtgagccactgcacccagtctgcactttctttattatctgtcttctttattatagccaatctagtgggtatgaagtaagtgtgtcatttgtgattttgattgttagtggtgactaaaaatgttgaatatctttacatgagcttgttggccatgtgcacatctttgttggagaaatatctattcaaatcttttgactattttaaaattgggttatttatctttttattgttgagctataggagttctttattttattttactgagacagggtcttgctctgtcacctaggctggagtgtagtgatgccatcttgactcactgcaacctctgcccccaccccaggctcaagtgatcctcccacctcagtcagcatcccacagctgggaccacaggcgcatgccaccatgcctggctaattttttttttttttttttttttgtattttagtatagacagagtctcaccttattgcccaggctggtctcaaactcctgagctgaagcaatccgcccatctcagcttcccaaagtgctggaattagaggcatgagccactgtgcctggcctattttattttaaagatgaggcctcactttgtcacccaggttggagtgcagtggcgtgatcatagttcactgccattttgccctcctgggctcaaacagtactcacgactcatcttcctgagtagctaggactgcaggcatgtcgctagcatgcccagctaaaacagttctttatattctagatcggggtgtccaatcttttgacttccctgggccacattagaagaagaagaattgtcttgggccacacataaaatacactaacagtaatgacagctgatgagctaaaaaaagaattaccaaaacatctcataatgttttaagaaagtttacaagtttatgttgggccacattcaaagccatcgtgggcctctggccgtgggttggatgagcttgttctaaatgctagacccttatcagatggatggtttgtagatatttatcgcatgctgtgggttttttttttttactttcttttaggtttttttttttcttaaataattaaactgattaaaagctttaatcttttcattttcttgataatgtcttttaaagcacaaagttttgtttcaatgatgtctaatttgtctatttttttttctttggttgcttgtcatacgtaagaaactgttgctaaatccagaatgctgaagatttacttgtgaactttgtttccttctatgagttttatagttttagctcttgtatttaggtctttgatacattttgaggtttttttgttgttgttgagacagtcttgctctgtcgcccaggctggagtgcagtggtgtgatcttggcttactgcaccctctgcctcctcggttcaagcaattctcatgcttcagcacccgagtagctcggattacaggcgtgcaccaccaagcctggctaatttttgtatttttagtaaagagggggcttcaccatgtttgtcaggttggtcttgaactcctgggctcaagcaatcctctcatctcggcctccccaagtgctgggattacaggcatgagccaccacgcccagcctgttttgagttcatttttaaaatatggtgtgaggtagaggtcccatttcattcctttgcctgtgggtatccagttgtcccagaaccatttgttgaaatgactcttgtttcctcattgagcaatgtcgtgagaccctatctccataaaaaataattaaaaaaaaaaaagaatgcagaaggaaacagttttgccaattttgtagtatttactgacaatttgcatatgtctttacattctttagctatttatttttcttttgaattactgcctttgttcatttttcttttggagttgtttgtctttttcttattaatttgtaagagattttgcaaatatatacaatttcttttctcttttttttgagatggagttttgctcttcttgcccaggctggagtgcagtggcatgatcttggcttactgcagcctctgcctcctggtttcaagagattcttctgcctcagcttcctgagtagctgggattacaggtgcccaccaccacacccagctaattttttttttttttttttgtatttttagtagagactcggtttcatcatgttggccagactggtctcaaactcctcacctcagttgatccacccaccttggcctcccaaagtgctgggattacagttgtgagccaccgtgcctggacctcccacattattttgaaacaaattccatatcacataatttcttttttttgagacagagtctcgctctgtcacccaggctggaatgctgtggcgtgacctgtgcttactgtaccttctgcctcctaggttcaagcgattctcctgcctcagtctcctgagtagctgggattacaggcacgcaccaccacacctggctagtttttgtatttttagtagagatggggtttcaacatgttggccaggctggtcttgaactcctggcctcaggtggtccgtccacttcggcctcccaaagtgctgggattacaggcttgagccactgcacccagccaatatcatataatttcatataaatagttctttgtgtatctttagataaggacttaaaagaaggcataatcgtaacaccattattaatacctaaaagaagtgagcaataaataattcatttgccgtatcaaatatccaatgttcatatttcctccattgtcccataataatttttaaaagtttgctcaaatcaaaatccaaacaagattatttcaaagcattgtttgaggtacattttaaatcttaatttatagatttctctgctgtctcttttcccccatatttatttgttgaagaaaccaagcgttgtttcctgtggactttcctactctctggattttgctggttatattcctctggtatcagtttactatgatccctttttcccctgtattttctgtaaatttgtaactagatctagagatttgtttagattttgtgggttttttttttttttttttttttttttgcaaaaatgcatcataaatggtggtgtgtacatctctcagaagacacatatcttaatgtctttttgtggtattagttattaatgattactgcctatatttattaattcattatttggattgtaagtttatgatagtctcttgatgctttttctgttgttagctggaatgcttctaaaaggagaaggctttcctcttcaagctacttggttgtcttgagggtttgcttcttatagggaaagcaggctaagggtgaaaaaggaaatagtttctaactgggtctgttaatgagctgtcaccccaggcaaagagaagcaaggcaggtcacaggaaagtgaagtgggcttgggatgattggtgccccatgcgtgcatgcatgaagggaagttaatcctccctgtagtgaactctactgggcttttggtcagtagccaagactgtcaaggaagacctttgtcagaagccatacctggcctttgcttttagctgttggtagctgaaggaaaccagaacagacctatgacctgtgaacttctgctcagtagacaaagttctctcagcctaaattcagtaagcaggagtaagatgcttgctttcccttgaagtgaaacgtgaattatatgtttcttcaacttgtgctaatattctttttttttttgagatggagtctcacactgtctcccaggctggagtgcagtggtgcaatctccgctcactgcaacctcagcctcccgagtagctgggattacaggcgcctgccaccacgcctggctaattttttgtatttttagcagagatggggtttcactatgttggccaggctggacttgaactcctgacctcacgatctgcctgcctcggtctcccaaagtgctgggattacaggcgtgagccaccacacctgggcaacttgtgctaatattcttaaccttcatgtgaatcattcctgccctcaggctagcataacccatacagccttccttataggaagatttcctactgggagtgaatttgtccagtgattcccccaagatatcccccaatcaaatattttaaaagtcatcatttacatgtaaaaactatgtaacaagcatggtagcagcagcgttaaagaaatggcagtatggcccctgtaagggaaggctccagaagatgagccgcactcagcctctaggtcacagctaccttaggagtttgcagttgttcctggggaagtcagtagacaaagctatctctcaggcctgggcaagatagggattttttttttttctttgagatggagtctcaccctgtcatccaggctggagtgcagcagcatgatctcggttcaccacaacctccacctcctgggttcaagtgattttactgcctcagcctcctgagtagctgggactacaggtgcgggccatcatgcctggctcatttttgtatttttagtagagatggggtttcaccatgttggctaggctagtctcaaactcctgacctcaggtgatccacctgcctcccagagtgctgggattataggcatgagccactgtgcccagtgtttttttttttttaattgtagtgacaggatctcactttgtttcctgggctattcccaaactccaggcctcaagccgtcctcctaccttagcctcccagagtgctggggttacaggtttgacccactgtgcctagtctcagaattcatgtttttaaaagtcactctgtgccaggctcatgcctgtaatcctaatactttgggaggctgaggcaggagggttgcttgagcccaggagtttgagaccagcctggaaaccatagcaaaatcctaactctacaaaaaatacaaaaaatagccaggtgtggtggcatgcacctgtagtcccggttacttgggaggctgaagtgcaaggatcgcttgagcctaggaagttgaggctgcagtgagctgtgatcatgccactgcacaacagcctgggcaacagagtgagaagtaactctggctgtggtggggaaagtggattagtggagaatggaagctgggaaacatggtggttcttgctaagtcagtatcaagggatcacagatgagggggctatttcgtcctaataagggccttggtctcccagatagtcatggatttttctatttagaagctccttctcagtttttcttgcccaaggcatatacggttgatatttgtacaacacaggctggatctgtatgggtccacttatatgtggattttttttcaaccaaacttggattaaaaatatagttgtaggccaggcacagtgacttatgcctgtaagcctagcactttgggagcccaaggcaggcggatcagctgaggtcaggagtttgagaccagcctggccaatgtggtgaaaccatgtgcctactaaaaatacaaaaaatagctgggtgtggtggtgtgcacttgtaatcccagctactcaggaggctgaagccagagaattgcttgaacccgggaggtggaggttgcagtgagctaacgcagcagaggttgcagtgagctaacgcagcagaggttgcagtgagccaacggggtggaggttgcagtgagccaagattgcaccaccacactctagcctgtgtgacagagcaagactctgtctcaaaaataaataaataaaaatacagtgtaggccaggtatagtggctcatgcctataatcccagaactttgagaggccaaggcaggcagatcagttgaagccaggagtttgagaccaacctggctaacatggtagaaccccacctctactaaacagaagtacagaaattaaccaggcataggtggtgcatgcctgtaatcccagctgcttgctaaactgaggcaggagaattgggaggcagaggttgcagtgagctacgattgtgccactggactccagactgggtgacagagcgagactctgtctccaagagaaaaaaaaaaattgtacttacaggacatgaaacccacctgtacggtgtgctgactgggagactggagtatgcatagttcttggtaaacaaggggattcctgaaaccaatcccctgagtatatggagggttgactatatattttaatagaatttattacttttttttttttttttagcagttttaggtttatggaaaaattgagcaggagtacatagtttctctatctccctcacatttccccattactagcatcttgaaatagtgtggtacatttgttacaactgaagagccaaatattgatacattactgttaactaaggtccgtaatttactttagagttcactcttggtgttgcagtttctatgagtgttggcaaatatatcatgacatgtatctagcattatagtatcatattgagtagtttcactgccctaaaaatcccctttgttccaccttttcatccctccatctacctgaacccctgataaccactgatccttttacagtctctatagttttaccttttacagaatgtcatatagttggaatcatacagattggcttctttccatgttccttcctggcttgatagctcttttcttttttttgagatggagtctcgctctcgcccaggctggagtgcagtggcgcaatcttggctcactgcaaactctccgcctcctgggttcaagcaattctcctgtctcagcctcccaagtagcttggactacaggcgcatacctcccctgcctggctaatgtttgtatttttggtaaaggtggggttttaccatattggtcaggctggtctcaaacacctgtcctcaggtgatccacccacctcggcctcccaaagtgctgggattacaggcgtgagccaccctgccctgccagctcttttttttgtactgctgaataatactccattgtataggtgtatgagtttatctattcaccttctgaaggacattttggttgctcctaagttttggcaattatgcatgaagttactataaacatctgtgtgtaggtttttgtgtggtcatgtttttagctcatttggataaataccaaggagcacgattgttggatcgtatggtaagagtatgtttagttttgtaagaaactgccaaactgtctttcagggtgactgtaccattttgcattcccaccagcaatgaatcaagttcctgtcgctccacatcctcgttagcatttggtgttgtcagtgttttggcttttcaccattctaatagatatgtagtgatatcttgtcttactttgcagttctctaatgacgtatgatgttgagcatcttttcatctgcttatttgttgttgttgttgttgtgttgttcattgaaatggaatctcgctctattgcccaggctggagtgcaatggtacaatcttggctcactgcaacctctgcctcctgggttcaagtgattctcctgcctcagctccccaggtagctgggattacaggcgcccgccaccatgcccggctagtttttgtatttttagtagagacaggatttcaccatgttggccaggctggtcttgaactcctgaccttaggtgatctgcccgcctcggcctcccaaagtgctgggattacaggcgtgagccactgcgcctggctttcatctgcttatttgatatgtgtatatgttatttggcaaagtatctgttctgatcttttgcccattttttaatcagattgttcttttattgcttctggggttctttttgtttgctttttttgagacagagtcttgctctgtcgcccagtctggaatgcagtggcatgatctcagctcactgcgacctctgcttcctgggttcaagtgattcttgtgccttagcctcccaaatagctgggattacaagcatgtgccactgcacctggctaatttttgtatttatagtagggacagggttttgccatgttggccaggctggtcttggactcctggtcttcagtgatccacccacctttgcctcccaaagtaatgagattacaggcgtgagccaccatgcccggcttattgttaagttttaagagttctttgtatatgtgtattttttgattcttttaaaattaatacttaataaaataattgtacatatttatgggatgcatgtgatattttgatacatgcatacaatgtggatcaaatcaaggtaattagagtattacctcaaacatttgtcatttctttatgttgggaacatttcaaaatgtctagctattttgaaatatacaataaattattatctataagtcacctcattgtgctgtcaaacattagaacttattctttctacctggctttattttttttaccccttaaccaaccattcttcatcagctccccgtctcccctactctttttttttttttttttttttgatacggagtcgctctgttacccaggctagagtacagtggcacaatctcgactcactgcagcttccgcctcccaggtttaagcaattctctgcctcagcctcccgagtagctgggattacaggcgaatgctaccacacccgactaatttttatatttttagtagagatggggtttcaccatcttagccagactggtcttgaactcttgacctcctgatccacccgcctcagcctcccaaagtgccgggattacaggggtgagccaccatgcctggcccctcttactcttttcttagcctctggtatctatcattctactctctacttctatgagatcaacttttttttagctcccacatatgagtaagaacatgtaatatttctctttctgggtctggcttctttgtatattttggataataagtcttttattagatacgtgttttgcaaatattttttccgagtccgtgacttatcttttcattctcttaaatagtgtcttttgcagagcacacattatacattttagtgcagtccagtttaccaattctttctttgatggattttgcttttggtattgtgtctagaaagtcttcgccaaaccacagtcatctagagttccccttatattatcttacaggagttttatagtttttgttttacatttaggtctgtgatctattttaagttaatttttatgtgaaagatataagatctatgtctggattctctctttttttgagatggagtctcgctttgtcgccaggctgaagtgcagtggcgcgatctcggctcactgcaacctctgactccctggttcaagggattctcctgcctcagcctcccgagtagcacatgacaccacgcccagctaatttttgtattttgagtagagacggggttgcaccatgttggccaggatggtcttgatctcttgacctcgtgatccgcccgcctcagcctcccaaagtgctgagattacaggcatgagccaccacgtccggccagtttttttgttttatttatttatttatttgaaacagggtcttgttctgttgcccaggctgcagtatagtgacaccatcaaggcttcgttgcagccttgacctcctagggtcaagttatcttcttgcttcagcctcctgagtagctgggactacaggtgagcaccactctgaccaggtactttttaaatttattttagagacagggttttaccatgttgcccaggctggtcttgaactcctgggctgaaatgcccctcctaccttggcctcccaaagtgttgggattacagacatgaggcactcagcccagccaatataattcttttttttttttttgagacagtcttactctgttgcccaggctggagtgcagtggcatgatcacagctcactgcaacctctgcctcctggactcaagctgtcctcccacctcagcctcccaagcagctgggattatgggtgcccatgaccacacccagctaagtttttaaatttttttagagattgaatctttctttttctcagcctggtctcaaactcctgagctcatatgatctgcccgcctccgtctcccaaagtgctgcgattacaggcatgaaccactacgcccagcctacaatttatttgtaatccaagttttattgaaaaaaaaatccacatataagtggacatatgtagatccaacctgtgttgttccagtgtcaaccatatataccaataattcttttttttttttttttttttttttttttttgagatggagtcttgctctgtcgcccaggctggagtgcagcggtgcaatctcatctcactgcaacctctgcctcccgggttcaagtaattctcctgcctcagcctcctgagcagctgggactacaggcatgcaccaccacgcccagataatttttgtatttttagtagagatggggtttcaccatattggccaggctggtctcaaactcctgacctcaagtgatccacccgccttggcctcccaaagtgttgggattacaggagtgagccactgtgcctggcctataattctttacgtatattgttagattcagtttgctagtattttatttagcatttgtgtatctgtgttcatgagaggtattgttctgtagttttctttggtttcttttctgtctggtttagggtaatgctggcctcatagaataggttaggaaatatttcctctgcttctgtttctgaaagagaattgaggtaatatctatttttttttttttgagatggaatcttgctctgtcgcctaggctggagtgtagtggcgcaatcttggttcactgcaacctctgcctcccaggttcaagtgattctcctgcctcagtctcctgagtagctagaattacaggcatgcaccaccatgcctggctaatttttgtatttttagtagagatggggtttcactatgtgggccaggctggtcttgaacttctgatctcaggtgatccacctgtcttgtcctcccaatgtgctgggattacaggcgtgagtcactgtgcctggcccgagataatatctaatttaacagtttggtagaattcaccagtgaacccatctgggcctggtgccttttgctttagaaggttattgattattgattcaatttccttaatagataaaggtgcattgagattgtcttttcttcttgggtaagttttaatacattgtgtctttcaagaaattgttccatttcatctaggttatcaaatttgtgggattagagtccttcataatatttctttgttttgcttttggtgtccataggttcagaagtgatggccctttttcattttttctattagtaatttgtgtctttgcccttttttttctttgttaatctggctagaagcttatcaattttgttgatcttttcaaagaaccagtttttggtttcactgatttttctctattaattttgttttcaatttaattgatttctgctctaattggttttcttctgctcactttggatttaattttttttagtttttctagaaaactaagtttttaagtgaaaactgagattattgatttttagatcttttttctaatgtttacagttaacactgtacaatttcctgtaagcactgctttctctatatcttacaaattttgatgtcatattttcattttcatttagttagaaatatctcttgagacttctttgacccatctgttatttagaagtgtattgtttaatctccaagtatgtattttgggatttttctggctatctttctgctgttgatttctagtttaattacatgtggtctgagagcataccttgtatgctttctattcttttcaatttgttaaggtgctctttgtggctcaaggtggtctactttttttttttttttttttttaaagaaaagctggccaggtgcagtggcttatgcctgtactccagcactttgggaggcgtaagtgggaggatcacttgaggtcaggagtttgagaccagcctgggcaacatatagagacttcacttgcacaacaaatttttaaaatattagttgggtatggtggcatatacctgtatatggctgaagtgggaggattgcttgagccctggaggttgaggctacatgagccatgatcgcaccactgtactccagcctgggcaacagagtgaaattttgttctctcttgaaaagaaaaaaaaagttgatgacataaagttcattcatcttttttgtatgtgacttcaaaataactactgatggttaaaaaaaaaatcagaatgatgcaacccaagtgtccatcaatggatgaatagataatatgtggtgtatgaatacaatgggctactattattcagcctttaaaaataagaaaatgctgacactgctgtaacatggatgaacgttcagatcattatgctaaatgagaaaagccagacacaaaaggacaaatattgcatgattgcacttatatgaggtatctggaatataagagtcatagaaacagtaattcagtaattagaataatgcttgccagggcctgtggggaggagggaatgaggaattcatgtttaatgggtacagagtttcatttggaaaagattaaaaagttatggaggtggatggtggtgaggattgcacaacagtgtgaatgtacttaataccactgaactgtacacctaaaaatgattaaaatggtacattttatgttacatatgttttacaacaatttttacagatggaaaaaaattataaaaaacatcaggatggtgttgacagtgaaaaggttaaagagttactttaaaaatttactttattccagccgggtgcggtggctcacacctgtaatcccagcactttgggagaccgaggcgggtggatcacctgaggtcaggagtttgagaccagcctgaccaacatggagaaaccccgtctctactaaaaatacaaaattagccaggtgtggtggcgcatgcctgtaatcccagctacttgggaggctgaggcaggagaatcgcttgaacccgggtggtggaggttgcagtgagccgagatcttgccattgcactccagcctgggcaacaaagcgcaactccgtctcaaaagaaaattttttttttttactttatcccaaatgtttatatttactttggggcttatgtgaccagtttaattttcatttgtaattgacttgatagaacacactaatgttcagttaagatttcttatggtgtggtgaggagtaggatttttatgtaaataagcccaaaattgtatatatgaggttaatctgatatttgcagaagatattcatgcattactgtaaggaccactctgcttattcatttgaccgatttgttacaacatggttagaaatcatcaaggtgtttgagatcaaaggatcttcagaggtgatttactccaatccttttttaaaaaattaataacttgagcctcagagaagttaagtgacattaccaagttctgctgttagtatagtgactttatctttacctgaatccagggtttcttagccctagtctgtaatgtgtcctagtgtgcctctagaatctggtcctgtcagcccaagtctgttaaatcaaataaaaccagggcttggtgcttcaccttgtcttctgccataccgttgggtttcctgtggaccatgcagataatgatgatgggctcagtgggcttgatagtgataactcctaaagcagctccttctaagtgcggttctcaatctgaggaagttaaaaaaaaaattagtgactagaacccacttctcaggtactctgataaaatacatttgtaggggagtgatagttttcactttctttttttctttttcttttttttttgagatggcgtctcgctcttttgcccaggctggagtgcaatggtgcgatctcagcttactgcaacctctgcctcccagtttcaagtgattcttctgccttagcttcctgagtagctgagattacaggtgtgtgccaccatgcctggctaatttttgtatttttattagagacgggatttcaccatggttggtcaggttggtctcgaactcctaaccttgtgatctgcctgcctcagcctcccagagtgctgggattacaggcatgagccactgtgcccagccttcacatattttttgaaataataggccagttgcggtggttcatgcctgtaatctcacactttgggaggccgaggtgggcagatcacttgaggccaggagttcaaggccaccctggccaacatggcgaaaccctgtttctactaaaaatacaaaaaaattagccgggtatgatggcatgtgcctgtggtcccagctactctggaagttgaggcatgagaatcgctttaacttaggaggtggaggttgcagtgaggcaagatcgtgcccctgcactccagcctgggtgacagagcgagactccatctcaaaaaaaaaaaaaaaaatcgtatgcagtaaaggttgaaaactgctgcccaaaggcgctattaaactataggttcccaaacctggccaattgtcaaaatccctcaagaaggggcagtggggtctaagggaccccattgctgtagaggagattagtagtccaagagtgagatgaactgttggaagtcctcaaacttccaaactattaaaatagaatagttttgcttccttaaaatagaatagttttcttcctcactgatttttctgtattgattagaaccataacaagtgaattaaacaactacaaaatagttatgtgggccacagacattattgtaatgaagtgaagtttggctcaggccttgtaacacaattgctttttggattaaaagtaaaaatattaaattgtgaaattatgtgtaagttttaaaaaattggtcttgtacaaaagtgttgggtttttctttgtttttaactggatttgtttttaagcaagacagaatatttatattgttggagagtcacaaaggaggtgtgtttgtggatttaaatgtggagacagtgtgccttgaaatgccctttatcagtctgattcaagccacctgcaatcatggatttgaacttttttttttttttcccctgagatagggttgcctaggctggggtgcagtggtgtgatcttggctcactgcaacctctggctcagcctcttggagtacctgggactataggcacacaacatcatatccagctattgtatttttttttttttttttttttatagagacagagtttcaccatgttgtccaggctggtcttgaactcctgagctcaagcaactcacctgcctcggccttccagagtgctgagattataggtgtgagccaccatgcccagccttcactttatttaaaaaccatagtttttaaaagccacattcctactgatgaacacagaggttgtttccagtgttttcatttgcagggctgtagtgattgtttttgcacatgcctctttatgtacatgtgctgtgtcttctgggacagagagtggacattttaagtgttttattggtcctgctaaattgtctttcagccaaactgctgcagaggtgatggagatgaggtgggtactcaggagaattatgctcagtgcttgtgtgctagtcactgacctggaaacattttattaaaaatgctagattaggttagtgatgtaaataccaggtgatagtaaccagaataattgtgtcaaaacatcaagaatcatcaagagatgccaggcatggtggctcatgcctgtaatctcagccctttagtaggaggccgaggtgggcagattgcttgagctcaggagttcaagaccagcctaggcaacatggtgaaaccctgtctctaccaaaaatacaaaaatttgctggatgcagtggtacgtgcatgtggtcccagctactcagtaggctgaggcgggaggatcgcttgagcctgggaggcagaggttgcagtgagccaagactacactacagcccgggcaacagagtgaaaccctgccataaaaaaaggagaaaaagaatcatcaagagaaaacttaatttgatgtgctctgcgttttctttggtgcttcatgtcagtgttagaaactataggttgtatatttattaatttttctcctacatttgttcaacttgactaaaatattaactccaaatgcctagaatttcaaaatacctcttcgttataaagtatcaactatttcttagtccccttaagctgatagtattgtgtcattgtaaaagatcccttgtgaaaaataatttttgtcaacatgaaaggtcttaatgtgtctcctagtttacattttacatggtcttttccatgtatttatatagttgacatatatagctttttttgtaaatacactttcctatgtgaacatgccaaggtttacttaagcattctcttattcttggacatctaaattgcttcttattttctattgtaaataaagtgctagaagcttctttcctgaaaagttatttacttttcacctagtatttccatctgtgttcctcaaaataagattgctgagattcatgtatgttgccagaaagattgtgaggtttaacagtgaatgaggaaaacttttaacactcaaggtctaccaagtacagcaagttttattttacctttttttttttttttttttttttttttttttgagttaggccaagttgcctaggctgggctcaagcaatccttctgcctcagcctccggagtagctgggattataggtgtgcagcaccacacccggctttcttgtattttttttttatttttatttatttatttatttttgagatggagtttcactcttgtcacccaggctggagtgcaatggcccaatctcgactcaccgcaacctctgcctcccaggttcaagcgattcttctgcctcagcctcccaagtagctgggattacaggcatgtgccaccacacccggctaatttttctatttttagtagagacggggttcctccatgttggtcaggctggtctcaaactcccgacctcaggtgatccacccacctgagcctcccaaagtgctgggattacaggtgtgagccaccgtgcctggctgctttcttgtattttatcttgctgtagcggttgtgggatttttgcctggtgtgttcattggagtgtgtgtgtgtgttttgagatgtatgactgtgttggttgtgttgtcatactttgaaggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtacacagatgtgcctgctaataacttctgtagacagcaaagtttaagagaaattaggtggtaaatgcaacatatgtatctaaataaatttggtctgagggatttgataagatgaaacagtacatagtccagaaaatttttatactcaaagaattatagaaaatatctgaaatgttttcagttttgtgcatatccagaaaatgtcatcctgtgatctgctggttggcagcccaatggcagtattagatgtattgtttttattttgttttgtttgctatttatttggttaagagagttacctaattaggagtgtgaaaaaaaagatttattatagtagtgggcttttgtttgacttaaaacatttttgttgttaccacagtatgagtgccttgtttgtgaaatttgtttaccgggaagccatatacttagagtagcttttagtttatcattatcatcatcatcatcatcatcatcatcatcatcatcatctccttcatcatgaaaggaagaagctaccaatgttgctttattctgcaaaaaatacaatagatgcttgttgaaagtatggagtgaaatcttaaatatgtctgttaaaaagagtacaactggccaggggtagtgcctcatgcctgtaatcccagcactttgggaggccaaggcgggcagatcgcttgagccaggagtttgagaccagcctgggcaacatggtgaaatcctgtctctacaaaaaaaaaaaaaatagacaaaaattagctgggtgtgatggcatgcagctgtagtcccagctacagtggggctgaggcagggggattgcttgagcccaggaagtaaaggctgcagtgagctatggttgtgccactgcattccagtgtgggtaacagaacgaaaccctgtctcaaaaaaaaaaaaatagtacaactttaagcaggatgtgggcacatgcctgtagtctcagctacttgggaggctaagtcaggagagtcacttgagcccaggagcttgatgctgcagtgagatgtgattgtgccactgccttccagcctggggatgatagcaagaccccatctctaaaaaaaaaacaaaaaacaaaaaaaaaacagagtacaacaacctttggtaaacttggaatataaaggtgtttccttaacctgttaaagagctgataaagagtggtactttcaaaccagtacacattatgtgaaacactagagacacttcccatttgttaaaagaaaaaccttagccaaattaaatttaagttttttttggagacagagtcttgctttgtcacccaggctggagtgcagtggtgcaagcacagctcactgcaacctccgccttctgggttcaagtgattttcctgcctcagcctcctgcgtagctgggactacaggtgtgcaccaccacgcctgggtgatttttgtattttttgtagacatggggttttgccatgttgcccagtctggtcttgaactcctgggctcaagcaatctgcctgcctgggcctctgaaagtgctgggattacaggcgtgagccaccatgccatttaatggtttaattgagcaaagaatgatttgcaaattgggcagcctcccgagccagagtaggttcagagactccagcacagccatgtcgtggaaaaagatttatgaatggaaagaggaaagtgatgtaccgaaaacggaagtgaggtacagaaacagccggattggttacagctctgaatttgccttatttgaacacaagttgaggtttgtacagttggccacctttgattggccaaaactcggtgattggcacaagagcaggttatagtctgtttacatctccattttggttatagttcattatggacagaaaaacctgtaggtcaaacttaaaatatgtaaggagacagttttaggctaaacttgatttaacacattaaatccgtaacaagacaggatgcctgccctcaccatgttatttgatcttattttagtaattctagccaatgtagtagggcaagaaaactgcctgcttggctacaaaataaacacacaaaagtcagtatctgtaatatgtgacagaaaatataattaaaaaaaaaaaaaaaagccgggcacagtggcccatgactgtaatcctagcactttgggaggccaacgtgggtggatctcttgagctcaggagttcaagaccatcctaggcaacatggcaaaaccccgtctctacaaaaaatacaaaaaaattagccacgtgtggtggtgagctcctatagtcccagctactttggaggctgaggttggaggatcatttgaacctgagaagcacaggttatagtgagctgagatcacgccactgcactccagcctgggtgacaaagtgagactctgtctaaaaaaaaaaaaaaaagaagaaaaggaaaggaaagtaaaagaaaaaataatttcacttactagagcatcaaatccctaagataatttagagcaaagccagaaaagtgaagaaaatataaaaatctttacagtgggttgcattttaaaaaaaaacttgaagatatcagatcaactcactaatgtattaattaatataatttaaattaaaatcccactgatttttttgtggggagggtgggagagtcatttgttaaaatgattctaaagagcatctggaagaataagcaggcaagaatagccaagaacattttgaaaactaaagatgagtttggaagacgattggttttgtactgtcaactacttatagattttacatgaattttaaagggtaatctgagccctcgaatagacagaaatagccatagatctgaaagaacacttaagacctgatccagctatccatgagagtatatataatcaaagtctttgtgtgtgaatcaggagtctttcaggtgcaaggtaaataaactcataattgcttacgcaaaggtggtatttgctttagtgactccagagaaagctcaagtgcctatctctcccctgactttgattctttttggggttggctccattctctcctgttgctaatggcttcctttgtgcagccagaggaaaggaggtgtggttttttgatacttccaggcttctatttttatagcttgagatcaaagagggaagtgaccttccttagagtcagtgtgtaaagtcctaaggaagataccacgtggggtgctggggccatgtgcccatccctggcccatgaccatggggatgctacactaactgggggccacgcatggctgttcctgccctgaactgccagctggctttgcagtgcagcctcaccagaatcacatggaatagtagggatatgaattgtttcccaaagaaagtgtgtggggtggtagaattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttctttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccctctcctcagcctcctgggtaactgggattacagctatacaccactgtgcccagtgtgacaattatgaataaggctgctgtaaacttctgtgtaggtttttttgtgtgtggacattggttttcagttcattatggtaaataccaaggagtgcagttgctggattgtatggtaaaagtatgtttagtttgctaaggaactgccagctgggtgtggtggctcatgcctgtaatcctagcataatgggaggctgagacaggaggatcccttgaagccaggagttcgagactagcctgggcaacatagtgagacctcatctctacaaaaaatttaaaaattagctgggcgtggtcttatgtgcctatagtcctaactgcttgggagactgaggtgggaggatcacttgagcccaggagctggaggtggcagtaaactgtgatcataccactgcactgctgcctgggtgacaaagcaagaccctgacttaaaaaaaaaaagagaaaagaaaaaaagatgagtcagagggtaaggaagcaaaaataagtaaataaataaatagaagagaaaagaaaaaagaaaaaactgtctttcaaagtggctgcgccattttgcattcctaccagcaatgaatgagagtctgttgttgcacatcctcaccagcatttggtgttgtcagtgttctggattttgaatattctattaggtatataatgctgtctcacttgttttaatcaatgatatatgacattgagcatctttttaatatgtttacttctcatctatgtatcttctttagtgaggcctttgtttaggtcttctgcccattttaaaaaatgggttcattttcttattgttgaatatcatgagttctttgtctattttgaatacctgccttttgctttatttttgtgttttttattttttttttttattgagacaagttctcactctgttgcccaggctagagtgcagtggcatgaacatggctcactgcagcctcaacttctcccagcctcaagcaatcctcttgcctcagccttccgagtagctgggactataggcacacaccaccatgccctgctaatttaaaagagtttttttttgtagaggtgggatctcgccatgttacccaggtggtcttgaactcctggcctcaggcaatcttccagccctcagcctcccaaagtgctgattataggcctgagccacttagcctagctcagaatttattttttatttgttaattttgaaaaaatataggacctcataaaagtcagtctacatttgtacacattatgtttttggtgaatatgtaaatggattctttgtgaatcaatttggttttgtttttttgcttttaaaaataccagccctgggctggatgcggtggctcacgcctgtaatcctagcactttgggaggctgaggcaggtggatctcctgaggtcaggagtttgagaccagcctggccaacatggtgaaacgctgtctctactaaaaatacaaaaattagctgggcgtggtggcgcatgtcagtaatcccagctacttaggaggctgaggcatgagaatcgattgaacctgggaggcagaggttgcagtgagccgagatcgcgccactgcactccaaccttggcgatagagcaagactctgtctcaagaaaaaaaaaaatgccagcagtggctggctgaggtggctcacacctataatcccagcactttgggaagccaaggcaggtagatctcttgtggtcaggagttcaagaccagcctggcgaacatggcgaaaccccatctctaccaaaaatacaaaaattagctggatgtggtagtgcgcacctgtaatttcagctgctggggaggctgagacatgagaatcacttggaccctggaggcagaggttggagtgagccactgtattccagcctgggtgaaagagggatactctatttaaaaaaaaaaaaaaaaaaagcgggctggatacagtggtgcacacctgtaaccctagcactttgggaggctgaggtgctcagattgcttgagctcaggagtttgagaccagcctagacaacatagtgagacatcgtccctaaagaaaaaaaaaaaataccagcacttagccaaaagatttcaacagtgcagaaaaagaaagttgtgatatcttttctccaaattagtcttgttttcagtttcattatccaagtaaccactactaatagttaaaacatttgaaatacgtgtgggagcttgtcctatttaatataaattatttattgagcaaataatcaccactagtatgttttggatactggaattttcatatgtaggagtccttgaatgtaaggtgcccctttggtagttctgtgcttcttttacctgtactgtaacatagggaaagatgttacaaatggttgtatttttaacagagcagtatctattcttaaacaccagcccttccactaaaggtaaacaacaaatgaatacataaatgaagttttggtattgggattatgtgggttaaacacatccatatttcattattaatatttaagaatataacaaactttttattggcatttggaccttgtagctaaggaaagattaaactttgtttatttgtgctttgttttttttcttcactcagatatttgaggatttcccatttgaggaatacatttattaatcaagctttagtttcaagatccttgatcttagggaataccatcaaccgttcttctttaagcttcctaactttgcccaaatttggttagaactactcaagagtagtttgggtaattcagaaattttattggaaggggaaagaatttttgacccaaattagataaagcaactcttgggtaatgatttcttttcttgttctctctttataatcaattgaaagtagtagtaaggctgggtggcaaaagaaagaggcctggggagaatcgcgtggttttcattatctcttttcatagcagcaaagtgggaagggaccaagaggaaatcaactgaaaaaccatccttctgaaacattggcctaaaaaactgtagtccagaaattgagtgcaactggcagtggcatttaaaaggaatgctctaatttctaggaaagcaggcacgagtacctcttaaaagaagaaaaaaatgaaaactgtaatttaggacacatagacgagtatccattccctgtacttttactctcatgtcctaaccaaggaagggttgccatagcaaatatggcattccttagccatgattcactgttgtaaatgcctgcagcattcataaaagtaagatatatgggctcttctttttccttttaaatctttatttctgtatttaaatctgtatgtcatcatctgtattttctctcttgttttttttaaatcttgggagatggtacaaattatttaggggagggaatgagtttcttgtccacaaatagaggagagagagggctttttgtctttctgctttggaactggagagcttcctatttaggcatggcctttttcaagtgaccttgtattgttatcagtactgtagaaggtaggcacgttgtgtaaactttaaaattgaaagccattaggcattccacttgtaaaccttggctttttaaagaaaattacatgttcattgtgaatattttcttatcgacctatctctgtgcacatgcagacttcctttgcctacattctgaaaggtgtaattgccttctttaaggacagcggacatctatagttcttgggtcaaattgtcctccttctggttttgtcagttctcagccacactgtgtgagcatccattttcttggattctggttcggagctcattttaaggaacatcatgtcccttttgagactctgtggacattggggtgggtagatgtccccctgtgaacagaaggtccctccctaaggaggtgcttctctgtgttgagtcctgcatctgggcacacagagcccgaagcaggaagagttgagtctgaatagggaggcctgtaagcctgactgctctgccacgggtaggcctggtctgccatgctccaggagcccccaggaggctctgaagtcattctgcctctgggaattttacagaggagctaatatttgagctgagtgagaaggtgattcttgaaaaagcaaggcgtgccctggtccagttctgtggggctgtcgtagaagagggctcggaagctcttgggagtgaggctagaaaggtaggcagtgttaccataaggaggttggaagtgacacagataggctaaggaaggggacttcagtaatcatgcagcaatggcctggaaaagggagaggctcatagtagggagaccagtttggaggctgccatagtgttctactgagagagaaaaagacttgaactcagagcacggtcagggaaggtggaggggcagggtctgatttggaagtgttttgttttttggttttgggaacaaggatttggaaacctcttggctccgtagatgaagaaaggtgaaccaaggaagactgaagtttccactcaaggaaacagtaactcagggaagaaaacacaggagtaggaataggtttaagagaatgacaagcagttgtgttttggacttgtttagttcgaggtgacatctttgtagggatgtctagctggtagctgcaagtataggaggaggctggatgtgtgcatgagtttcttggtaaagatccatctgcagtctcctgaagatgtcacccagattgccctgccatcaccccagggccttgagtcactcgcttctcttggtgtctaggcaggcttgaagaaaatcaaacagtacaaaatcatgcaaattcagacctctattccaccccagaggaaagtcctgctagcagtttttgtgtattcttccagaaatttgccttgcaacgcgtttgagtatataaataatcccagaaaggatgggccagacactagcagaaactcaccacacacactgcactgggcatgcagaaactttgcaaaatgtactggtgtgtgctgtcactgcattcctgggtttggaggtcttctgtgtccccagctgtcagtattgcccacaggctgaccactgagctccttccacagccggcccatatcaccctctttcgaagtgtgtctgcaaggctagattattagagtaatttaagtgtttctgctttgtgttttctttaatgaatttttttatgatgaagttcttgttttaaaaatatacagtggtaattaacatgtatgcatttttcttaaaatgacccccccagtccctcttcggatgtgatcactgttaacagtatcgtatatagaccctgttctgtgtggggcgggcagagggctggttagtgggtggaacatgcatactcacaaccatatttttcacatgggaaaatataaaggtgacaacaaatctcctggactataatctcatcaagcagacaataatctctgtttcaaaagtggacaaatacatgctgattttttaaaaaaaattataatagtacagaaagatacaaaaataagttaaagtcttcctaactctcctgcctgtgccctccactgggcaaaagtccctgtccctaaggtaatatctgttaacagttctccttccagaaaacttgcaatgcaaataggaacattttgtgtgtctgcctctgtgtgtatgtgtttacatgtcttttttttttttttttttttttttttttttttttttttttttttttttttgagacagagtcttgctctgttatccaggctggagtgcagtggcatgatctcagcttgctgtgatctctgcctcctgggttcaagtgattctcatgcctcagcctcccgagtagctggaattacaggcgcctgccaccacacccagctaatttttgtatttttagtagagatggggtttcgccatgttggccaggctggtctgaaactcctgacatcaagtgatctacccgcctcagcctcccaaagtgctgggattacaggtgtgagccactgcttctgcccctgcacatgtctaacgcacacaaaagagattctgctgaacacattttttatgctttttctttccaatttaacatatttgacatctttatcagcttatatagctttatttttttaagaggttattggctataaagggaaagtgctttatgggtgcttctgttgttatttaattggatcctgttgatggacattgatatcatttctaaattttttagtatcctaattaatcctgtggtgagcatccttatacagatatccttgttccctcatgaaaatatttctggaggatggaaagaagggaaattttaaaaattatttgtgtaaacattatcgtttgttagtagaatgacctcaggagagattgtagtaatttatacttccccacatgcatatgaatgccttttcaatatattgtttcaaaattggatatcatgaaccttaagagataaatatatatgtatgtattttttttttttttttttttttggtgggggcatgtcctgttattgacagtttgttttggtggagggatgtcctgttattgacagttatcgaatagaactttgtcagttccttcatgtaagggatgaatttggtaataaaacaggtctgacttcagttatggaactgggaaagctggaccttgatgtggaggtgggctcagacatgctgtgtctgggcaggtatctcttgggaagcagtgtcatccctgaacagaaacatggatgagccgcaggggacggtgctgagcagaggggctggccgtgggtcatctgcctcccttggcctagaaggcacaagggagctttccaccttgcctttggttttgagaatgcagaagctactaagcaactcacagtgtgcccagggtggtccagctgaaggatgcgaaatggttcttccttttccagccaaagatcttgaacctcccaccccatgacaagcattataaaattcacataattttgataggctggattccttttctgtagcagatctttcctcagaacagaagtttgttttttttttttaacctaaattacctgtgagttttattttttaaatatggaatctgttttttggacacctccttgtcatattaaatgttctgttattaattttgagattttaatgtaaattttaccccagcaaattaattttgtttctcttgctctctctttttttttttttggcatcctttcccgttgtatagtggtgctcattttatcatactgcttttatatgacttttcttttgtgaacagggatcttgttcacttttccttttttaaaaatttttttatttttttgagacggagtcttgctctgttgcccaggctggagaacagaggcacaatctcagcccactgcaagttttgtcttccgggctcaagcgattctcccaccttagcctcttgagtagctgggattacaggcgtgcaccatcacgcctggctaatttttttgtatttttgtagagatggggtttcactatgtcatccaggctggtctcgaactcctggactcaagcgatccacccgcctcagcctcacaaaatgctagggttacaggcgtgagccactgtgcccgagccacttttccttttaacataaaaacattgatatcctagagagggcactgtattttgggtacatacaggttcagatcacggaagagttgtattctatactttttttcatcattcttagttcagtatgatgtattttataatttcatatgagaaactgtaacaatgggcatgtgtcatccagcaatacctactcataaatcatattaaattttgatccaaacatgggagaaactgaagttttctctgtgtacttggatgctttcagaggcataaaattatattaccatgtgaaagcaagcctacaaaattcctcaggtggtccactctgccactcaaatgagagccagacttacagtgcacactctacaaacggacttccagctcgtcagggtattttaagtgcctgaatatgcaaggcactgtgccagtaaaattactcagtcctgaggatagagcctgttagaattattttaaaatctgtacttgaagtttatttcctcagtattccaagatattttatctggttgttctctgagtatttcacacgtagctagttacatataggtgagatggtgatgcttgtgcctggtgtggatgagaaactgagcctggcagacccgagattggatttcctcttctgactttgcaagtgtggctttgctttaataatagccctcctctttttctgtattcctcttttctccttccagtgtggcaaatatgcatcaatcaaaatacaataacctgtggaaccattttttctaaaataggaaggtggtgccatgggctattgattgttgagggtagtcttcagagcctgtcttataaatctataataattccccccaaattaatgtgctagttagaaccctagaattgcagcactgaaagtgaattttagaatcttttccaactttttaccaagctcagaaagcccttttattggacctttgtttgcctcatggtcatctggtttctttatgctggtagtaacaggaaccttactaacctacaaggtgacccagtccatcctgggcagctgtgatcattggaaagctctgaatcattcatctggaagctgcctgtggcagaatagtacagaacatatgcattgcacacactacaaaactgctttaaataagtgttccttttcattgttagatggaagtgacccagggcaaggatcatgttttatgagccagttttctcctagtgccttgaacataggcacttggtagtgtttagagaatgaattgtcttttttttttttgagacaaagtctcactccattgcccaggctggattgcagtggcacggtgtcagctcactgcagcctccacctcccaagttgaagtgatttttgtgcctcatcctcccgaggagctggaattacaggcatgcgccaccacacccagctaatttttatatttttagtagagatggggttttgcgtgttggccagatggtctccaactcctggcctcaggcgatctgcctgcctcagcctcccaaagtgctgggattacaggcgtgagccactgcgcctggccagagaatgaattcttaataagtttcttatgacttcagattgactggcagttgtgctaaatattttttgcctttatttgaattagaaaattcgtaagggggccttgagagtagatgcagtcacatttaggagatttttcccccccattggttaaaatgcagtttttctatggatctgctttagaactacaaataaactccgatcactcacagcagactacgcaatgagataagaagcagtccatttgttctgtcgtttattcatggccctcatctttgccagccaacctgtgcagaagagcacagcaaagcataagcttcctaacagctattcccattcagctgctgtcttcaagaagcagaagggtttagataaccttagagaacataatcaaacctgggaaactcaaatcaaaacaaaacttcgaaacggaagttgaaggtcctgaggtacccagaggcatagcaaggaaaacgtccccactgggatatcttctggattcacctacagacctctctggagttttaagatccacgttttatgacatattgcatagcaaacaggccgaacgctgttgtaaatcatcctctacgaaaggcccaggttttgaaactgaaggcctgaaaaggctcctgcttaccagctgtgtgctgtacctgacacactgaagcctgagagtgccagtcacctgtcagagggaacacagctgccctcaggcagaacctgagtctagaactcaaggtttttgactcttaggctaaaaataaaaaatcagaaggaggaactatggattgcttaatcagtcacattttcactttctaaggtttcttgtagcaaaagttatagtctttggggattgggatgtagacacttttttttccttccctaaaacaatttttggcctgccagtttttcgagcttcctgctctggaccctgaagttgccatgcagttgcagacatgctcctccttcaaggctctgttaagctgtggctgcccttccttaccactgctgtgccccaggccaaaccccctgcccctccttcccctaaggcactttgcacctgttgctccgagccttctggtctatcccagttggtagagtccctgtgcttacctctgtggctcagtcctcgtgggtggtcagtgctctagggaaggtgagctgaccacttcactttcccttcccagccatagctcttcacagcctcaccaacttagaaaggaatgctgcttttctctctgtcccccgtcctgactatgttcaagtcattgctcagcccagtgagtttgtcctttcttccagaccagtagttttcccccagtccctcaggcttcagcccttgaaggcatccttagccccccaccaccatgatagtcaggcgctgcgcctatccgcagggtgtgggtatgtgtgtgtcttttgtttctggagcccattcctttccttccaccagcctctaggccttcatccaatccttttgcaactcagtgattcatgacttttccctgcatccagtctagtctctttgctggtccattgtttccatagttgccagtttaatcttcttaaaatgctgcatttttgaagtcagtctcttttggtccctctcagaaacatttaaatagctatctgttgccacagggggaaagcttgaacctcttagccagtcattcagagcctgccctctgctggggcctgctttcctctacagatgcttctcccactctgcctgccacagcccttgtagctggctgattgccctgtacctcgcaggctctggaagtcttcagctccttcatggagcctttgccagccattcttttcaagactttgctgttgttcactgcctgatttgttcatttgacacttaattcactgagcaaacattatgaaagatgtactgtttgctactgtgaggaatggatccccaagagataagagggtcagtccctactgccaggaaacttgcctgtgtcacctgggttcagtatcttgtgtctattagatcagaagtggaaaggcagaggccagcccgtatgcttgttttattttatttaaatcaccagcaccccagcaagtgttttgcacaggaaatttctcattatttaattattttgggttttttgattaaattctgtacattcccattttagcttatcttgagttataacattaaaattaaggtagtcatcagctgaattataagacttaattagataagattatttaagatagtgatttctcattagattggccctgttcatattaacttttctgtttttttcttcagtctgcatgaagaaatcagtgatttttatgaatacatgtctccaagacctgaggaggagaagatgcggatggaggtggtgaacaggatcgagagtgtaattaaggagctctggcccagcgctgacgtgagtcccttcctgggtagcttatgcttcggacagtccttgtccacgggctagaagcctatctgctggtatctcatgctagtcctcacatgcaagtagaagtgctctgtagagttgtggtctaattaaattttaaaggcaaacaattttctgcagtctttagaattgaggcttcctaactattttcattggattggatgactaacaactattttttttttgtagtgctaatagcaactactaaaggcaagctatccttagaaattattagtgtaaagagaagaaagacaaatcaaacctcattgttgtagtggtctgttattggatatgatatatcaaaacctcattactacttagttccagcctgccagggtaaacattatataattgtttacagctaaatgaaaatgtcaagtaagaacttttgtcacttgaagttcatttcctttggctaatgcacgcataagtcttttcttatttctttcctgaaattgccatttttcatctctctcagaccagctaattgccttttagacagctcccagtcagtgaacaaaatgattactcaggatttcttcttggcttatttgtcgtttttgttactggtactaagtcttttgttttttgtttttgagatggggtctcactctgttgctgaggctggagtgcaatagtgcgatcacgacttactgcagcctcgatttcctgggctcaggtgatccacctcagcatcccgagtagctgggactgcaggtgcacgccaccacacttagctaatttttgtatttttttgtagagactgagtctcactatgttgcccaggttggtcttgaactcctgggttcaagcaatgtgcccgccttggcctcccaaagtgctaggattacaggtgtgagccaccacacttggcctgttactggtactaagttaatacgtcactttttagggcactttgagggcctgttctacaattttgtgtatgcaaagaagtacacaaaataatactaataaaatccattactttgtgtttgtagcttttcttcaggcactgtcctgggtggtggtgggaagctagggaaggtttttttccaattggcaaaacaaagaagtttcattgtatgtaaaacttgcaagtatatgacagtatgtatatgacactgtaggtaaagggaaaaggcaagggtactaatgttttatgagcaatgaccatacatcgcattctttctcctatgtgatccaaatcagtggttctcagctagtggctattttgttctccagggggcatttggcaatgtccgagacatatttgattgtcctgactgggtacgcactgctagtacctagtgggtagaggccatggatgccatcagccattctatgatgaacagtataggcccttacaacaaagaattatccacccccaaatgccaatgttgagaagccgtgatctaacttaacccttatctttcttaggtggaggttgattatctatctatctctttctctccagccagccaggcagccatcatctgtctacctacagatgaggaacatgagcttgtggttaggttcccaggtccatctcgcctcagaggttgaactggtttcactgtttatcatttttttcccccgagatggagtctcgctctgtcgcccaggctggagtgcagtgacatgatctcagctcactgcagcctttgcctcccaggttcaagaaattttcctgtctcagcctcccaagtagctggggttcaggcgcccgtcaccacacctggctgatttttgtaattttagtagaggtgggatttcatcatgttggccaggctggtcttgaactcctgacatcaggtgacccacctgccttggcctcccaaagtgctgggattacaggcgtgagccactgtgcccggcctatcctttttttattacaattacctgcatacatatttctgcctgagttccaccgttctccatgggttgagatggaatgcatcccagttttatgccacagcatgatgttacctgatgttctttgtggaattgacctaaaggccctcacttgccctacagttaaagtagtctgatcccaatttagtaatctattcgaagactcctgcttagagaacaaaaatgaaggatttgtgattgtgtctctggataatgagggaacattagtgatctgaactgcttctgaaagtttcctgtggttggctttctgtatccacaggtaccacacctccatattaaaccaacaatggattgaaaatattcagaaaaaactataaaaataacaatgtaccaataaaaacaatacaaattattttaaaaatacagtataacaactatttaggtagcatttacatcatacttggtattataggtattataagtaatctaaagatgatgtaaagtacatgggaggactagcataggttgcatgcaaatactctaccattttatagcagggactcaagcatcttcagattttggcatggtgggactggaaccaatctcctgccgataccaagggacaactgtattttggtctatgtgtttcatattgaaccagataagtttaaattatattcagaatgtctgcttgtgaaacagaatccccgcttcatgaagcttggggttagaaaaaaatgctcttgtcataccaaaaagtaccagtagagggtagcaaaaactgacatttctccatatcttggtgactcaatatgataacaacttctgataactcaatataataacaacttctttttctgtttcaggtccagatatttggaagttttaaaactggactttatttacctactaggttagtacactcatgaatctttcaaaggacttttcttagagtgtattcattttggctgtcaaatttgtaaggagtagaaacaaaacaaatttataaaacaaaatggggctgggcatggtggctcatgcctgtaatcctagcacttcgggaggccaaggagggtggatcatttgaggtcaggagttcaagaccagcctggccaacatggtaaaaccccatctctactagaaatacaagaattagccaggcgtagcagtgcgcacctgtaatcccagctactcaggaggctgaggcaggagaattgcttgaacccgggaggtgaaggttgcagtgagccgagatcgcgccactgcactccagcctgggcgacagagcaagactctgtctcaaaaaataagtaagtaaataaataaaggatttaccagcatttaatttgatttaccttgaagtagaatatcacttcacatcatcttaccaagacatagatggtacagagagatggaaaagggatcatgttgcaatggaatcaattagttactaattttagaaattgactgcctggcagagtattgctcagtcccataacttaacccactgacacagatgttaatgtagtatcatgataaaatgtctgattatatatcctcttgaatgtgagttcccgctgtcttgctcactcactcttacactcaccctcgctttcaaattaagaactcattctactagttatggctccagcatcctgatccagaaattcagggtacagatctcttctctgagaaagatcttggcctttcaggactgttgttcagtttcagtcttctcaaatgagacctcttgtgacgcacagccttggaggctctcttttgggaaatgataatgtttctccaaagggtgaatacttgctctctaagaattgaaattgtttgaacattccatcatggttattattattattaccttaaattttaatctctccagaataaagtcagcatcatgtttttccatttgagcttgatttggtatactttaccccaacttaaagtgtgctgaagtggatggaccctggcaatttccgttcttctcatagatgcccttggcctgcaaaagtcataaaatactcaacttcgagttaatatttcttatttaggttgtcagcatcagtaaaacatgaaaaatcacctttcttaaaaaatttaattaaattttatgaataggtagtacattcacatagttcacatttggaaaaggcacaaaaatcaatacagggaaaagtctcagtcccacctctgccccctggttctccttggaacagccgcttttaccagtttctcacatatcctttcagagatatctgtgcatataaaaggacatgtgtgtatattaacacaaatggtagcatgctggatacctgttctgcatccagcttaaagcacttcataatatttctgagttgcaattaatctcatccggataggaaaatcattatgtctagtaccacaagcgtttattaaagaaaatacatgaagtgctttttgtttttttttctttgaggttttacttctttcaaaatcaccctatttcctgaggcctgaattctgtgaaatgactgagaggaggagtttgttaaaatcaacaactactatttcccttctccacaaaaccattatcaccaacacatttagtcttcgttggccagggtgggaaataggttttaattgtactaatgaagtctataagcatgagtgtcagttaaaacaagtttccaacttcttccgaccctcttgtatatgtattctgtgttcagtgacatcgacctagtggtgtttgggaagtgggagaacctacccctctggactctggaagaagctcttcggaaacacaaagtcgcagatgaggattcggtgaaagttttagacaaagcaactgtaagttctgcagcatttcatattaaaatccttagttatttacctatgaaacttgaattaaaattaaagtttggtgagcacagttgcattgcaagtgagtgattctttcattttgttaatgtcaccgtgcttgcacataaaaagttttctggttgtccacactggagtgtgaccatacaatctcggctcactacaacctgtgcctcctcggctcaagtgatccttctacctcagcctcttggggagctgtactacaaacacaacctgccatgcctggctaattttgttgtattttttgtagagacggggtttcaccgtgttacccagactgatctccaactcctgggctcaagtgatccacccacctctgcctcccaaaatgctgggattacaggcgtgagccactgcacctggtctgcatttcttttcacagcagcaaaatatgcaattttattatacacagtactcactgtagagatttttgtttgttttattcattttttttagagagatacagtctcactatgttgcccaggctggtctctaactcctggactcaagtgatcctcccacctcagccttatgtgtatctgggactaaggcgcaccctaccacgccctgcttatttaaaaaatttttttttgtagagatagggtctccctgtgttgcccaagttaggccattttttgaaaagaactgctgatagctcatgtaaataatcctgtcagctttttagaataatttttatattttatcttgtcaggttgttttttgggctatttgcaaaactgaccagtaatgcaagtgggttgtagtgtacaccttaagaatccagcaattttcttattagaaacagtttgatgatacaaaacatttaatacctggcattcctagttcttcatcttatactcagaaagtgttctccaaattattgaggaaggtttttgttcattttaaaattatcattataactatatgtcaactaataaatgagatgatgggcatattaatttatttaactgtagtaatcacttcagtatgtatatcaagataagtatatcaaaacatgtacaccttaaatataaacaataaaaataaataataaaaaattggacaccaaacaaaattctcggttgatagaaattatactgtaatatactgtatgggacccagtgctaaatatgcagcatatagtatttgtagcagaccaggtttactggggtgtgccatatttagaatactcagtgttcttatgctctcatgagatgatggagacctcatgtctagtaggcttccatcccctgattttatcatttaatctggttaaagcatttacattttacctttcttctctttataggtacctattattaaattaacagattcttttactgaagtgaaagttgatatcagctttaatgtacagaatggcgtgagagcagctgacctcatcaaagattttaccaaggtcagagaatttagcgtttatacaacaaaactattagaaacgtaattttaagattctgttgtggtggtgttctaatatttttatatgcatgttgctgtctctctctctctcttttaaatagagctagggtctcactctgtcacctaggctggagtgcagtggctggatcatggcccgctgcagcctcaaactcctgggttcaagtggtcatctcacctcagcctcccaagtagctgggactacagacgtgagccactacacctggctattttttgtattttttttttttttttagtgttggggtctcgctgtgttggccaggctggtctcttaactcctggccttagcctcccaaagcactgggattacaggcatgagccaccatgctcagcctgcaccttacttttgtatgcaacggttttgctttctttgaatctgcttgtaatgatcagtgattaacttataatgtgacctcaagtaagaattaaaagttgagaaagcttttgaagaaattgtctgctctagatccttccttgtagagacagaagagatggaattctactacacagttgattccatctgtttttaaccttcaggagttcagattaagaacctttcctttaacccatttcccatatgccccaagaatactgtgcgggcagtgagctgcactttttttttttcttttttcgaggcagagtctctctctgtcacccgggctggagtgcagtggcacgatcttggttcactgccacctccgcctcccgggttcaagcaattcttctgcctcagtctcatgagtacctgggactcgtgcctgggacgagtaccaggcacctgccaccatgcctggctaatttttgtatttttattagagatggggtttcaccatattggccaggctggtctcgaactcctgaccttgtgatccgcctacctcggcctcccaaagtgcccggattacaggcgtgagccaccgtgcccagctgtacttttttttttcctaaacaggaaataggttaagagttttaagagccttttctagatttcaatccctaaattacctttaaggtgtttcctacaggcttccttacttctgttttgaaattatttaagtttatttctattctgttttcttccaagatagagaataatttgtcaccatcatctgtggaacattttacatacttaggtagttgtcagctttctcacctctaacctaagccattaactcctttggcttctgttagaatattcacaattttttttttctgtagcagctctaaagtttctatttcttcttttttgttttttaagaaaaaaatgttaactacttgatgttacaagcattatcatcttgcataaatgtatggaagacagaaaagcagaaaaataaaagaaagattatccataatcgcactatattgggggtgtgtgtgtgtgtgtctgtctaatattttctttttctggaaaaaacttttaaaaattgaaattcatatgcatgataacattcatcagtataaagagacagtgtaaagtgagtcacccttacaccatagatacttagatcatttttacagaatttctcattgccaattattgttttttgcgttgcttttttatgttctttaaaattataagcaaaaggagtagcacattatacacacattgtcttataacttcataaaaacttaatgttttggaggtttcttccatattagcacatacaggcttgctttattctttttgttggttacacaggcagtagtcttttataaggctgtgactgcttgatttagcagttcttcagtattgttccagttttcttttgctattagaaaaagggattgatgaatatacttccatacatgcatcttgctttacacatgcaaaatgtttgtagaaagattcccaaaagcaaaattttgaggtcgaagggtatatccagataaaattctgttggatatttccctaattatttattctttcatattctcattttctctctctccctcccccttttcttctccctccccctcttcctctatccctccctttcccttttctctctttttctttccctcccttttcttttctcttttctcttcttcctttttcttccttcccctttcccttttccttccttctgcttcctttttttcctttctttcattttttgacaccgagtctcactctgttacccaggctagagcgcagtgatcatggctcactgcagcctcggcttcttgggctcaagtgatcctcccaccttggcctgagtatctgggatcacaggcttgcccaccacacctggctaactttttttttaatttttttttttttgagatggagtctcactctgttgcccaggctggagtgcagtggcgcgatcttggctcactgcaacctccgtctcccaggttcaagcgattctcctgccttagcctcctgagtagctgggattagaggcgcacaccaccacgctcagctaatttttgtatttgtagtagagatgtggttgcaccatgttggccagggtggtctcaaaccctgacctcaggtgatccgccctcctcagcctcccgcagtgctgggattacaggcgtgagccactgagcccggccacttttttattttattttttaagtagagatgaggtcttgctatgtggccacttttttttttctttttttttaagtagagataaggtcttgctatgttgcccaagctgttcttaaactcctgggctcaagcagtcctccttccttgacctcccaaagtgttgggattacaggcatgaaccaccacacctgacccctaattgttctttgaaagggaactgtatctagactgacttaaccaccatgttttgttttgttttttgagacagagtcttgctctgtcactcaggctggagtgcaatggtgcgatcatggctcattgtaccctccgcctcctgagttcaaacgattcttgtgcctcagcctccagaatagctgggactacatatgtgtgccaccacgctgggctaatttttgtatttttagtagagatggggtttctccatgttggccaggctggtcttgaactcctgacctcaagagatccacccgcctcagcctcccagagtgctgggattacagatatgagccaccgtgcccagcccacaatgtttaaaaatacttatttctccatatttttgttctttcctatgcttgcttagtttgatacaatttgcaaaagtataagcttttttttcttttttatagaagccatgcgtgttcattgtaggacatctagaaaacagagataagagtaaagaaaaaaaaatggaaatcaccggccaggtgctatgtttcacacctgtaatcccaacactttgggaggcccagacaggcagatcatttgagcttaggagttcaagaccagcccgggcaatgtggtgaaaccctgtctctacaaaaatacaaaaattagctgggcatggtgggctgaggtcggaggatcacttgagcccaggagctggagattgcaatgagccaagattgtgctactgtactccagcctgggtgacagaatgagggggaaaaaaatggaaatcactagtaattttaccaccctaagtaataatagctgttaagacttctttgaagatgttgtgcctgctttgtttccctccgtggccccagcctatggcatggtttacagaggagtgaatgaatatgtgcacagcaaaaggtggactcattctgtacatacttgcccactcaggtgttctctcgggtagccctgcctcattccctgtgaagcgtggaagggaggggtggtctgtgtgtagtcatcagcccatgtgcaagtcagcaggcaggactcttgtttgccccagggctgtggcagaataatctaaaggtcgctagtctacagtggtacatcaccaagaaaagtgattcttaaaaatctcactgatttagtgctttaagatgttggttactttgtccttgtactctttctattctctgtttacaaatgaatattagagggtcatggtcacaaatgagcatcatcagttacatgctgttagtgtttctatcctatagcaagtacttttttttttttttgagatggagtcttgctctgtcacccaggctggggtgcaatggcacgatctcgcctcactacatcctctgcctcccgggttcaagtgattctcctgcctcagcctcccaagtagctgggattacaggctcccaccaccactcctggctattttttgtatttttagtagagataggcgtttcaccatgttggccaggctggtctcgaactcctgacctcaggtgatctgcccgccttggtctcccaaagtgctaggattacaggcatgagccaccatgcccagccctgtagcaagtacttagatactattattcatttgtacatgtcttacaatttaagtataaggggagaaccattcattacctatagtttacttttttttaatagcttactcttaaaatagaaaattaagtatgttgtatatctctaccaaattttataatgtaaggaccaatttatgcccctcttaatgcttagatctgttgctgatacaggaattcattgaaaatacaattttctttttcagaaatatcctgtattgccatacttggttttagtattgaaacaattcctattgcagagggaccttaatgaagtatttacaggtggaattggttcttatagtctctttttaatggcagtcagtttccttcaggtaagtcatatgggtatagcatgctagtgcacactaaaagcaaaagtgatcaatcagctgggaaacattttggaaaaaatcgaaatcaacctgtaattgcattgctttccttgattacttaacggcttttccctttaaactgggtacattttatcatttagcaaatatgtatttttaaattcctatgaaagaatatttttggttttaaatcccatacattctagtatttttgagacttttcactgcaaattttaacatgcaaaatgtacggcctggtttccataagcataaatagtataaatgccaacaataagaatgtcttctaagcagctaaatcttgtaagtttagttggaattgagaccagctatttgggtaagcgaattagagtcttagtattgtaagtgggtatgtttatgtggcacagggttgccaactgcctgagtctattcgtgagtcagaacgactttgctgatgtgttgggccaagccagccctggttggcagcctggtgcagccgtaaaattcagccttacaaacagtctcccgccattcccgcaccatgggactttagtgttgtgtgtaacaacagtataacctgctgttagcccattatcaactgactgctatgctaaaccaaaattataataatattgcttgtagaagttagaatataatttattccccctctccttgataatttagcaaaaatccaatataatttcttcttttctgcttttagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtattgaaattaggtaaatttgtgggcattcaaagagagggcactgtcagtcaccttattatactttaaattctctttagatgaaaaatgaaggaacaacttctaattgttattcttttttcatcgaaatatttcatgagcaaacatactaaaataaacagacacagacaatagaaaaacaccttggagacttccagataagtagggagtagaatctgtttaaccctaaaagcatagtagaaaaggcattcacttatttggatgggttcatgtttggtggctgtttctccttcttgggtccttattgccttgattacaaccaattgtcagcaattaatgaggctttaatgagatgattctgaagtcctgagaggcagcaagcatagtaatatatctttgaattcatgagcagaagggtgcaaggagacaatgtattttctttttgaatttctcctttcctgtttgattttgcatgtctctttgtgctttttccagcttcatgtgggcttgaaagtaagcagaaagtaaattccttccatgcttttctgaagttctgtttgcttgcttgtgtcctgatttttgtgagcaatattttttcttgatataattgtaaaatagattctgcgttattggacttcagtggaagtgcttttagtcatttgctttaatgtgtaaactttgaaaatgagtaaggaaagggggtgaagagatagagtagttgcctaggaaccattttctggcttattgagctgccttataaacattaatagttctatgtgtttattcattgaggaaacattacattgattgggagcctgctctgttcaaaagtattgggccaaaggacacgaagacttttcagcaagacgatccttgctttttaggggctcataatttagagtgagaaatagatatatagctaatataaacccaaaaaatatagaagtatttctgatgtaacttggggtttcactcttaggagtgaacagggcactatttcttttgtttgcataactgtttatgtatggaatgggataattcttgatgggccagaatacattccggcaactgatacaccataatgaagtaccaactgcatgattcacatattcagagactggggagctttggggacagctcacagctcagcttccaggcacaactctggtgggataactatggcccttgctctcctggaagagagtcatcaacatttagtgcatattaagcacagtcaggcttactatgttacgtatatttcttttaaaggtaacgatgttggaaggagttcatatggggccatgcaagtgaagcaggcctttgattatgcctacgttgttttgagtcatgctgtatcaccaatagcaaagtactatcccaacaatgaaacagaaaggtaaaagttcatctataaccagcccattgtgtcaaaattagttgtggcttcttatcttcaaattaatgttattccctccctctccctttctttttaaacacatgcagcatactaggtagaataattagagtaacagatgaagttgccacatatagagattggatatcaaagcagtggggcttgaagaatagacctgagccttcatgcaatggtaagatattttccttggtcgattgactgagtattagaggcttttctgtgttgtgtgcgtttaatgggaagaaacgttttccaatcttttgccactctttcaggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagtaagtatgaaagcctcggctcttctgaactcagatgcatgcacgttctcttgctggggttaacactgtctcgaaggctaaggctacttcctttgcttacatgttactgggatattttaataactttcatgcttgtacattttctcaacattttgttatgaaaaagttcaagcatatagtaaaagtgaacaaattttagtgagcattcatgtactcaccagtagattctgctattaaccttttacttgcttatgtcatacctgtctatccatcactctatccattaattcatcttattctttgatccatttcaaagtagattacagacatcagttcccctagagtactgtagcttgtgcatccttgtagccagactccagtatttgtttattgttttttccttttttttttttttgagacgggatctccctctgtcacccaggctggagtgcagtggtatgatctcggctcactgcaacctccgcctcccatgttcaaacgattctcctgcctcaacctcctgagtagctgggattacaggtgcgtaccaccatacccagctaattttttgtatttttagtagagacggggtttcaccatgttggtcaggctggtcctgaactcctgatcttgtgatccacccgcctcaacctcctaaattgctgggattacaggcatgagccaccacacctggcctttaacgtttttcttttcttttcttttcttttttttgagacggagtcttgctctgtcacccaggctggaatgtaatggcatgatcttcactcacctcaaccttcgcctcctgggttcaagcgattctcctgcctcagcctcctgagtatctaggattacaggcatgtgccaccacacccagctaattttttgtatttttagtagagatggggtttcaccatgttggccaggctggtctcgaattcctgacctcaagagatccacccgcctcagcctcccaaagtgctgggattacaggcgtgagcccagctgttatgactttttaacaccatagttagttttgcctgtttcagaatttcatacaaatggaaccacatagaatatagtcttgtgtaaggcttctttcactcaattttttttcagctttctggttgaattttttgttgttgttgttttgttttgttttttgagacggagtctcgctctgtcgcccaggctggagtgcagtggcgcgatcttggctcactgcaagctccgcctcccgggttcatgccattctgcctcagcctcccaagtagctgggactacaggtgcccgccaccacacccggctaattttttgtatttttagtagagccagggtttcaccgtggtcttgatcgcctgacctcatgatccgactgcctcggcctcccaaagtgctgggattacaggcgtgagccaccacgcctggccaaatttttttttagttgagatatagttaacataaaattcagcattaaaaatgtacaattcagtggtttttagaacatattcacaatgttgtgcagccatctccagtaattctagaacatttccatcaccccaagaagaaaccctgcatttagcagtagtttcttctaattcttccttccctcccttaacctctggtaacctctaatctactttctctttctatcctgatagaattttttttgttcccccatcctgatagaatttatgtgtcaattataatgtaagttaccttttaaaatcaaagtgaatttgtagtgtactgatttgagatctaaagcaggcttacctgtttgagtttaactttattaagtgtaggacatgaaaagtaatctaaatattgtatgttgttgatgatgaccatgtgtcaatatggaatcataaatcctcctgtgcagaatctccctgtgtgcttttttggttcctagagcagtatgctttggaggacagaagccaagctagatgtcacagacacagggagatggagtgttggggactgagagaatgtgactctgacatgctgggtagagtgccagggccagggtggagacctgcagagagacgtagcattgtcatggcccatgcagcccagaaataggtggagctcagcccactgtcgcgggaagtccacccccacccacaccagtatgtttggttagaatgatcactgatttgtcatcacagactctcagagattgaaccccttaaacccatcatcttgtgtctggctgaagccagggactaggacctaggttcctcactctttaccatactctttcattttctataaataaaaaaacaaataaacttagacctctgtgagctccttcaaggtcagatgtgggcagtggatttaacaatgaacagaagctctctgataaaatcagtcattttaaatgtttggaggaaaatttaaacaaacagttaattttttgtgtgcttcttttaactcccaaatgtttaaatttagtccagagagtactttaaccaaaattgtttttctttctgaatattgagtatctaaattactaatatgtcacattataactcacgtgacttgtgttaggattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcaggtgtgtggaacgtgggtttttaattgttagtatttgatacaaaatatttagaatttcccacatgtaaataatatgcagcatgggtttgaagaaaacgctagattgaagaacaaacttattttattctaagaggttccaacacatgacagtgcttctaggaacaggatgtcctaaggatccttgtgagacaccattgtaacataaatctcttcaggaatctattgactggtccttataagatgttccagccaaactaccatataaaaagtgtctcagttgtacatgaaataagctggcatgaaggttttgtgaggcctcatggcagtgtgcatatctgggaataatgtatccttttctaatattttaatgttcaataccttgttgctggtgttgaaatgatcagctggctgtcaggcgtggtcagttgattaacattagcttggacttaaaaggccacagagatactctagtttaagtttttttgttgcctagaattgtcattaactgagtaatgactcagagtgaggggaggaagccattgatatggggctctggcctaaggctgggtcactcctcactatagctgggaacctgggaataggcctcttggctgtaaccttgtgtctgatttgactcactgagttcactttacctacgcggccttagccatgtatgccagacacagacttatcacaaaataccagttcaagtgacagggttgacagaagggactgaggtcacgagaaagccacaggccatgagtagcaggaagggagtagccacctgtgctgacccaaacctaccagtgtgcctgtcatgcccaagagcctcttcccgctctgtcacttatgatgtggtgtttgggttggtaagtttcttaagaaaacctttgcatcccacacactgttaagaaggcgggcgagtggtctatgcttttcattatttccattaaaataaagtaagggttttagagctaaaaagaacccctgtaacagctttttctgcccactagataagtcagtgatcagtaaggtaacaatctagccagcatattcctagttttgaaagcttccccaaatccaggtgtttgagaacactctgcttttctgcaatactgatgtctttgtggtcgttttctgtttctgcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaa

SEQ ID NO: 394 - DNA, 82391 bp, Homo sapiens; identical to SEQ ID NO: 393

SEQ ID NO: 395 - DNA, 482516 bp, Homo sapiens
atgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtaagtttgtgaggctgctgggcgttagggcgagggcttggcgcccgggggagtccaggagggatagcgagaggcgcggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccgggcggggaggctgggtttggggcgcgggagcccggccagggacagccgcagaaggaaagtgggggtgtcgccgggggatagagtgggagcagcgtgagagcagtgttgggggcgcagagtggagggcaagcgtgtcttgaacagaacggcaggaggatgggtggaaagtggggcgcgtggaaagcggatttggacgagagcaaaggacgccggtggaagggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgtttgcctgtattgttttgtttgggggtcacggaagagggaaagtcggccaaattgattagggtatcatataaaagcagagattaggtccgggtagatcttttgagtgtgtgcaggaaaaggcttcattatagaatgctaaatttaatgtgagatgagagaatcttttactcccgatctcctgcatttgaaatacaaaggattgtacccttgggctggttcctggtccttaagtggaagcctaactggacactttttttctggaggattgttccctaaatcctgggaagctttagaaaatagtcaatggaatttttgttgccctaagataaagtcattacaaagaaaaaaaaaaaagaagaagaagaagaaagtaaaggtggtgaaatggcttgaggaggcagaatgagaaatagagatgtcagtcaaagtggaagaagagaaatcactttctctcactttagggatagatcttgttgataggcttagagcagtgattctccactgggggcagttttaccccctaggggatactgacaatgtctggagacatttttggttgtcacaactttgggggagaggtgctgctggtgtcttgtgggccaggccagggatgctgtgaacattctacaataaactggacagccttctgcaattatccagcccaaatgtcagtaatgcttaatttgagaaacttggctttcaataagatgtgcttaacattaaaagcaaccccttttaggatactttcaaatattcctattggaagtccatcttgaaaatcaagagtagttaataagagactttctttgcaaaatggtccatattcaaaaacacttgttttaaggaaattaaagaggcttccttttggcagaactgtttttcagcctttaaaaaacaaacaaacaaaaaatcttaagacatattgagaatttctaaaaggtgaatcatatgcatatgtgcatgtgagctaagtaaacattgtttgataaaaccaaatcagaactattctgctgtactaatttcactgaacttgtttggtaattgctttttaaaagcgataatcttaatttttaattcaaatgaatttaattaaaattacaacttgtaagttctttatcaagtgagggattgaacaatcagagaaaaatgttagacaaatatttatttgaaacaccccaaaatattccaaaatgaaatcttagtatttataggtatctacatagaaaggtaagaatgtcgtataattttctcgtattgtatttaatttccatttgaaatcgacagcatggagcgtattgagaagcatcaagcctttcgattccgtagcacaatacgttgcctagaaaggaggaacaataccttacactcataaatgtaataagatactgttctaatatcccctgcatgcaggagctcagagcacttattaggtaaaagccttgtcattagcacaatgaagcctagtgaaactaaaatttggtcgttgtatctaccccctcttctgtctcaccattccacccatttttgttattggtttgtttcagaattcattctgaaggtatcatcattagggttgcttacttcctttcttgttctaataactattccaatcacccttacctattactgtccctcagggatttgtgtcgcagcagacttgatactcctgctaagactctggggcacccagcaacgccaccccccccccgaccccgccctttctcctgtgcatacaaacacaaacagctcttttctgcttctaggtggaatggggatttgtacctgtcttggaaaaaggcagtggggagagcctttgtttttcacaaaggcaacctcagtttctctgcttctatatttactgaattggtttgttcaattgcatattcttgctattagagaggcttcctctttcccaagggaatagtgaaagacctgaggaaaagatgacttcagtgtaagcaacactggtactgatagaatgcacctgtcattggactacgtgaaaacccaataaatatggtttgaaccagtgataatcatatttgtaaattcaataagcatttgtaaactcagcagtagcaggttctgttctagacactgggactcttgcacttgcaatacccagatatatctctaaaagtatctgtacaaagaaacataagatgggcattcattttcattgaatttggagcaattatagagatatttcccgattgttgaaaagacttcagaacataattggtgagatgcagaaggcagaagaaatcattaaagggaaaacagttacatggatttctgtacagcctagacaaggaagaaatgagaaatttgaggtgaaaggggtcagttcttgtctcccttttcctttccttagcaaatgattattgattttgtttgacatctgagcaaggagaggtggtttccttccctgcagatacttgttgaatggatgtgtgcccttttgcacttctgatagccacagtggtagaagacaatgggctggctggcactggtagttagaggaagcagaatttcaaatcagttttgttctaatggtgtttgcagcaaaggctctaaccacacactttcaaagactgaacattctgtgtcactattttggggggattaatataaagactacagaactgagcatttttgttattttgggtactagggaatacctatgctttaaagtatacttgtttggagaaaccatatttatttgggggaaaaggaaatattgataagatggcagctccatttacctaaaaacaaacttgctgcttactctggcatgtcaattattgtgccagctggaaggagggtcatgtgagaattttatcaaacaccttatgttgttcttgttgaattcaggagcaacaacaaacacacacacacacacagagcaagattttgaaatttatgctgtagcaaaggcaaagagaatatctttttttaaaatttcattttatcttataattgttaaagataagtaatagcaatgcaggaaaaaggcaaccttgtttgtggaaggttttacttttgtttacaaatgcttattcatcttaagaaaaaaaatagcctggaacatttccccaggctttcagtcttctttataaatagtgtatctcttctatctctggattattcattatgtgatgccgtttggaatctgaatcctgggctcagatggctgatgtggttccttctgattttgtcattcagaattgtctctatcctcctaaagaaggtgaaagagacatgctgtttgtcattgggggcacagtaataggtgcaggctgtagtctgttttacagaattacatgcatgttgcttgaccttggtctgggaccccactgaccaaaacactgaactcagccttctggatcatgaagcctggtttttgcaattttgatttgaacaacagtgttttgaccaggtttgacaatcaactgatgtgtttggaaaagactgactgatgagccagaatactaaccacccatttacaaggaaagaggcacagacatttagggaagatcaagagctttgcagtcaaatctggcactcctgcttagtagtttgtgactttagatgagcttaactttatggaacttttatttcttcatctttaaaatgaagataattatgaagtgatttgcctgaggtcagtagtcactctgcatcatttcagcttagtttacagttttcaaaatctccatccaaacctctttctcaagagcatgcttattttcttggttaaatccatgtttcttctgtttatttaaaaatgctcaagaaccgatatttagctcaagagcttctcctttcagctgttagattctgttagaggcaaaaaaaaaaaaaaaaaaaggtaactgatgggtctctaattatgttcaattcaggtattcacctaaattgtcaaaaagattaaacgcctttttattttttcctaattgggatgaaaataagtagagctttaggtaaagatttctaaaaccaaacaaaaccatatgcataatgtctttcaactaggatgtattttttgatgatcagaaaattgaagattggcccttgctgataattctgttattaagtttatagatgtttttataccagtttagtgttgttgccattatggtttattgaagcatttcagattcaataaaaatctgaaaacctgttgtatgttgttcattgtaaaataaataatgtatgtattcttatttgtaatttatggtgactgatatgcatatgatcaattggaataatgaaagagttaaaattggaaaccagaacagatggaaactttgaaagaacattctctttagcaccacccaagtttgtattcaaatctctgttcctcagttattagctacaaaaaaattgggcaaattactttctaccttactactttttaagaatcatatccaccggattataggttatgattcctgtgatgattcggtgacataagcaagtaaagatgctagcatgatgtctggcaccctctttgtccttgtactctgctaattccaccacacttcagctgtgcccttgcaagtgatcatttatgcttgaattagttccaactgttttactctcaagaatcataaagcctgatctcaagtttcttgaggaaaaaaaagagagacatgattcatgactgtgtaagtggagccgggagctctatgtgactctaagcaggacctgattcagggctcacacccatgtgaccagttgcactgcagtttccattgcaatttcttagctcctcttccttaatcttggctatgtccttgacaggcttactcttcagggttctaagatggctgccagaagctttcagagcttcatgttcccaggttcaaacctagtgaagaggacagtctcttcctgtaccttttacagatgaaagaggaagctgctgttcctagaaattccagcaaatatccctggtcaggtcaagagccctccaccagtcatagtggctggaaaggtggaatatactggttgaggaagtgtgttttcccatagaaaattgagggattgctgtttgtatgctgattgtatgctagcacaataagaagccaccacagcatttatgttactgtttggccccaaagaaaaatgttagagccatggttttatttcatctgggtcatggttaaagtctagaggattctttctgtaccattactgaatatgtgtttccaatgattgatctgaattttcaagattaatgacagcagtgcccattagctctcttccttcaatctacatcattagactggctgggtacacactagaatttatgttttgctacaaacaactgttcaaggaacaaattaatatattttcttacattagatactaggtagtagaatcactgttttctgataaaagtcaggagctgtcatcatgtaaattgttaatctaacatcccgtgatttattcctttgttcctggcttaccttactaacctctggtccttcatctacataccaaattacactttacaggaaggctactaagatttatgtacaaacaagtcttagtatctacaaacatgggcaactaaaaaaaaaatccagaaaggttaacttgttaaatgtatattaaaaaaaaaaattctacatcatccattagggctgttgaatgcagtctcttaaatgcagtcattttctaagataaaatgtgatcttacttttttaattaacatattaatggactaaggatgctttctctcatttatttttcaccctttgcgtagatcacagtgactggatgtcatacatcacatattaagcagaagaatgttaacagccatgataaatggctttgagtgaaaaatattttcttctgttttcattcatccaatggtttagtcacataaataaatgtaagtgccttattttaaaatgtcttaaaatgggaaaataaaatcacatatctttgcatttttaaagttagtagctttcaggctactataaaatgtagtctgcttgtggtaagtatgtcagtgtagcaattggtttttccatatgtagtttccaacatgggaggtgggggagatactttagcacaatgcagttcaaaaattaaaaaccacagaaatgaaccagactttcattttctgttatatctatttaggttcttaaattcttaagaagactaaagaagttgaaaggtattctttcacacgactaaagtatcattgaagtgagatttttacctctttgccagcatgtttttaaatttccaatcagcagttacattggtgggtgtataacagagaaagcataaagtcatgtgaatgtttcagatacagtttttaattatctgaaatatgaaatgaacaactaagaagaaaaaattaccattctggcatggtaaaaatattctgtaattttaagaaatacctagagagaaatcattttaacatagcctttaaggcatagctgttgattatatactgtattaagagttttgtgtttgagtatcatgcacacattatgtttgttcctaaatattatgggtaaggttttctttggtattgcagtttttaaattatttttgctgtctaatgggactgaaaataaaaggtttttagtagcttaattagaaactatgcacttttaaaaagttttccatcaactgcctcttctgactgaagcacagagatttgcaaaaacagtaatagatacattatagataactacatagaaaagctctgaactaatcatttagattactttgtggaagggaatggagtaaggctgaaatttcactggaacttactaatagtagtaagtccaaataaggtaaatcttaaaacaaaacagaacaaaactcaaagttatgatgttgtaacttatcagagttccttcactgacttcaatagaagtgtattctattcagattaagcagaaaggaatccattggatggttatggaggagttcatggaattgaaggaaattctgaagagcaggaccttggacaggataatatcccagtgctggaatggatcagctctagctattttccatcattgtgtcactgtcctcaagactcagcatttagaaaggacagagagagagagagagagacagagtttgggggaagaataggccattttgaccaatagtcctaaagcataatctataatctgttactactggaagaggggaataaatgataatgtgcctgctgggcaggcacattagactgatgtccattcaggatgcagaaacttgttttagtgatcatgaattactagaaagagaaaaggaaaaccaaaacccttgagtgtattatctcaacaatgtctatatggtaaacagaaatactgttttcatttcctaaggctacataacaaactaccacaaactgggtagcttaaaacaacagaaatgtattctctcacagttctagaggctagaagtctaaaggtgttgacacggccattcgggctttggaggctgtatggggaaaatctgcttcatgcctttctcttagcttctagttttgctggccgtccctggcatttgttggtttatagactcatcacaccaccagtctccatcttcatcatctcatggctttctcttctgtgtctctgactcaaattcatagagacagaaagtagaatggtgtttgcaaggggatgggtgatgggggcatagggagtcagtgtttaatgggtacagagtttcagtctgaaaggtgaaaagactactggagatgggtggtggtgatggttgcacaacggtttgaaggtactggatgtcactgaagtgtgcacttaaaaacggttcacatggtaaatgtaatatcgtgtattttaccacaattaaaaaaaattaaacatgtaaaaagtgaagaagaagaaattagtgaaaatttctaattcttaaaaatcaagtgagggccagtaggatagttgagagtaactgggagcctcagacacaagggaaatctgtgctcatccatgagttctttcccagggacctttacttagtacttatcagaaattttggggacagagaagttgaccagagaaagccccctttggttccacaggtgtgcaggtactgagaccctgcccttaggaacaggcacaaaatcccacataccaccccagatttttctctcatgtgaaaagccttacacaactaggggaagggcagaaactatagggcccacggttctgcgcttatccaaagcagaggtctgcaagccatatagagcatagtttggtgccacatgaagagggaggggcagaaaagttgtggaaaagccagcccaaggcccaggtccatggggcctaagactaaggttggactcagagaactcaaaagtttacagcagctgcgttcataattgctccaaattggaaataacccagatgtctgtcagttgaggaatggataaacaaatagtcatggattccacagaatagaattttacttggcaatagaaaggaatagagggaattttatagacctcaccactgtaccggtgatcactgaggataaccactgggacaggagccatgaaagtttcatgaaaacgttcggacaatgtaaatgtttggaagtagattaagacagttatatgccaggtgcggtggctcacgcctgtaatcccaggactttgggaggccaaagtgggtggaacacgagtcaggaatttgagaccagcctggccaagatggtgaaaccccgtgtttactaaaaatataaaaattagccgggtgcactggcgcacgcctgtagtcccagctacatgggaggctgagagaggagaatcgcttgaacttgggaggtggaggttgcagtaagcagagatcgtgccactgcactctaccctgggtgacagagcaagactctatctcaaaaaaaaaaaaaaaaaaaaaaaagacacttatatagaaagcaggagtacttagaagggctgattataaggggagaatataaggccaggaatgagggaccataatttttcagtgagaaaaataccctatatacaatctgaattttttcattatcatacataaaatactactgatttatatgctatattctatttttaaaactcaaacccatttatcaatatatatacaactttccccctaccccaaacttatgtcaagttaatcatagtctccaagtttaaatgattttaaaattaatctaaaatctttctaaaataggtggttttaacctgtagctcactgacatggatagaattcagttaattcacaaacctggacagagaaaatgacatctttattgttacctctaattggaatttggcatattcattaattatgggtgtgggtcagaaaccacataagtaattagcagtacctgtcactttgtcaccagtagaagtcacagagaatatatcacattacagctgtttgcagatattttgaaaaaccatttatgctcatcacaactttgaaaatatgattattagacctgctgttagaactttttatttcaagtatagttgactcgaacaatatgagagttaatggtgctgacctgccccacagttgaaaatacacatataacattcgacccctcaaaaacttaactactaatagcctactattgaccagaagccttaccaataacatggctattgtgtgtgtgatatgtattatatactgtattcttaaaagaaagtaaactagagaaaagaaaatgctattaagaaaattataaggaagataacatatgtttatacattaagtggaagtgaataatcataaaggtctttatccttatcctcttcacacagagtaggctgagaaggaggagaaagaagagggacttgtcttgctttcttggggtggcagagatggaagaaaattcacttataaatgggcccatacagttcaaacctgtgttgtccaagggtcaactgtattaataaagaaacacatagactgtgtcagaaattcattcttttaaaatttgataactgtttctcattgcatttagtttcatttgaaatcctatgtatctcatttttagaatgtattataggttttacagactcccagagggattcgtagatgaagaacctaaaatctttctttgattcctcccagtagtaagttctattcagtgtgaacactggtgtggtccagaaagccagaactattgagggtgttctgtccacgcttgtgcttgatctgccagatgtcagctatgcaattccataggaaacactggttctagcaggtttcatgccatttgctgagttagcacgtttctgagcatctgtagattctctgtgggctttctacagggcttttcctatgtggagcaacgcagtcttagaattaagtgccatgtacaacccattgtaacctttcctatcaggaggcctaggctttagaccataccatatgcatgactctggatccctggaaccctagatggagagaggcagctctgaatctgttgggttcaacctcatgtgtctgtggattccagaaggaccgacgtcaaacttccaggcccatagatcagggatatttttctaagttttaatgtggttccctggcaggctgggtatgacttaaatgaacataccatccttgcctagatctatactcttatcttttaaactttatttattctaagggctgtcatgccaaagcatatcatttgagtgacttaaatatcagtggaggtagtagtcaaagggcctccccctgaggagtaggagaattgcttcctcatgagtcgtatttacaattagatacatacccattttaaagctaaacttcctaaccattttaataaagcttatttcttttttgactccctgacaggaagttttggctcttttagggtaaaatctgcttcagtttaacttctgtcattgacctaactcaggtcagtgaaacctcacaattatttaggaatttcctgaagttactaaaatgctcttactgtggccttcctgatgtattcaaggaatgctaatcatagtgacatctgccaaatcaaaatatatttactgggaaacagcagttttaggttgcatgaaacttttttttttaaccctttgaccagcctcttcccaaatgcacagaacatttttctaacaaatgctgaggatccaagtatgtgccaggcactcagccgaacatgggatacaataaggggtaaagcaaacatggcccatgctttcatggagctaatagtataatatttgtgctggggagaggatgtcagttagactacctggaaggtgctctgaaggccaagcagaggcggtcagcaggttgtgctgcagaggaacatgacactgagaatggaggggctgcctagtttgaaggccacttggagctggcggcaggagtagagaggtgttccaggcagaggaaataggttggcacatatgaggacaccaaagatggtcagagtgtctggggcaaggtgagtgtgggaccagatggaggtggagaggtaagccagtgccagataatccagagtcctcttggtgaggctaaggattttggtctttgaagcagggggtgacatgatcaaccatcctttattggcacagacataatgatatctattttccaagagaacagatagtattcagcaaaatcagcatgcctagcaactttttaaaaagtcttctatttaaacataatggacatgatacatataccataatacatatacaacattacaaatatgccttcacctctggatagcaagctttcagtttcagtgctaggattagattacttagtttctctgaggttctgaggggagggaattctaaaccacttgcctttgtcatttgcctttgaagaattgtttgtaaagtttccattataaaaagctattaacattaacctcaatctttttttaaaaaaaaaggctgttaaaattattcagctgtttgcttgctattgccatagcttacttgtttatttgaactttattataaagggctggagatactgttactgtaattgaattgaattgacttgaaaaatagtcccttatagggatggtaatctctagtacatttaaatatatataaaataagttctagggtacatgtgcacaatgtgcaggtttgttacatatgtatacatgtgccatgttggtgtgctgcacccattaactcgtcatttacattaggtatatctcctaatgctatccctccccactgcccccaccccacaacaggccccggtgtgtgatgttctagaaaattttgagtccccatttgattagcaaacatgagccaaagtcatactaaacaattgtgtacatggccctctcagctaatcctctgaattaaaagtccttgcaatctttagatcatttgagtaagaatgtaaaatgcagttttcatttcatgcttatatttttttaaatgagaaaattttgtctgcagagtaattgggcagctctgcctcatttttagtgttaactaccagtggggattaattacttgccagctcattatattattctcatggaaactcagagtttgtttgtggatattttggagtattggacagtaacaagtgtccttccgtttaatgctgccaccctaggtctgtgtgtccccatatgtgcaatttctgaaacgtttcatgtgaagcaaagacagcttgtgctgaaacagctggcctccacctgcacttgggaggctcattattattcaccaggtacttattatctagtaagcagaagacgtaagaagttgcatattgattctgcatcgtgatgcactttcaaagaccccttaaacaaggatattcagaggaggtgactagagcagttgcagagaattatttttctgtgtgtgtggcatctttatacacgacgtcaacaagagccttagagtctgactactatcagaggaccttgttctctagcaggttctgtttttgagactgtacttctgtgaatgtgtgtctttatgcatcattcctttgtggacttccctccttctgggaatgtgtgtctttaatctatgcaacattcctttgtggactgccctcgccccgtaaccacctttttcagtcctgtggtagatgtggggctaatgtgacctatccagccaaataactctcacctctagtctcagtgagttgctcaaggatagattcatggtctaagttggtaaaatgatgaccttattccctgggattttgacagaacactaaaaacatgctgtctttctcatggagcttacaaagctattaggattcttgcctagtgcagctgatgcccatcattgttatccagtggaggaagcctgcctgaaagagaaattagtcaaaacaaaacaaaaagtaaaaaagtacatctagcccattaatcccaccacacctgcagccagtatgatttctgaatatttcagctgcattaacccattatttttcacttctatttaagctaatttaagttagggtttttttttttttttttcaatgaaaagaattaaaacataaatgctgcctaaactgtccctacactgaggtggcagcaggaagggagaggtctgaagatatcatctggtatagatgtaaaaatttctgttgccctgagccaaaaagagtttgtaagtgagaccaaagaaggtggtaacttttctctcctgtttccattttctttaagtagcactggatgttttaacaaaacctgtttacattccgaggttgtagaatcctagtttttctcatatacagaaatgagagactttgtgttgctatgtactacagaaacaaacataaatgagctggatgaatcctagttacagctttgccatttgaaatccatggatacatttatttctcataaatttgcttttagcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggcaacaaaagtagaaggaatgtccaaatatttcctatagcctgtcatgaatgtggttctgaccagaattgatcggaattgatttaagaacacctcccttgacaacctaaatatgtgtgtgtatatatatatgtatgtgtgtgtgtgtatatatatatagtgtgtatatatatggtgtgtatatgtatatacacaccatatatatactctctatatatttatatacacatacattatatattaatatatacacacacatactctatctatatttaaatttatgtattaaatatacaaatttatatatttatatattatatatatttatatataaatatatagagagaatatgtatttgtgtgtatatatatgtgtatataaatatatatgtgtacatatatatagtatattcttaagatacctgcataataaactgtgagtcattttcattctgaatttcagggattcacaactcattcattcattcgttctttcattcagcaagtatgtcgattgtgcactctttgccaaacattgggaaaaaagtggtgaataacaccagagaaatccttgttttcacagactctgctttccagtttatagtgacaatcatccaagggacatacctcaaaataataggagacatctatgacgaactcacagccagcatcatactgaatgggcaaaagctggaagcattccccttaagaactgaaataagacaaggatgcccactctaaccactcctattcaacctagtactggaagtcttagccaaagcaatcaggcaagaggaagaaatacaaggcatccaaataggaaaataagttatcaagctatctctcttcgcttctatacctagaaaactccaaagactcttccaaaatactgctagaactgataagctattttaataagttttcagtatacaaaatcaatgtataaaaatcagtaacatttgtatacaccaataatgtccaggctaagagtcaaatcaagatcacaatcccatttacaatagccacaaagaaaggaaatacttaggaacacagctaaccaaggaggtggaagacttctgcaaggagaattacaaaacactgctggaagaaatcagagatgatacaaataaatagaaaaacattcaatgctcatggattggaagaatcaatttcattaaaatggccataccgtctaaagcaatttatagattcaatgctattcctatcaaaccatcaatgtaattcttcccagaattagatcacactacctgatttcaaactatcctacaaagctatagtaaccaaaacaacacggtactggtacaaagacagacacactgatatgggttggctatgtccccacccaaatcccatcttgaattgtagttctcataatccccatgtgtcatgggagtgacccagtgggaagtaactgaatcatcggggctgttacccccatgctgttctcatgatagtgagtgagtgagttccaccagatctgatggttttataagggactttcccctttgactggcacttctccttgctactgccatgtgaagaaggacatgtttgcttccccttccaccatgattgtaagtttcctgaggccttcccagccctgcagaactgggagtcaattaaacctctttccttcttaaattacccagtctcaggtatttcttcatagcagtgtgagaatggactaatacacacatagacgaatggaacagggtaaaaatctcagaaataaagccacacacttaatctgattttctacaaggttggtaaaaacaagcaatagggaaaggactccctattcaataaatggtgcagacataactggctagccatatgcagaataatgaaactggacccttacttttcaccaaatacgataattaactcaagttggattaaaaatttaaatgtaagatctcaagctacaaaaatcctagaagaaaacctaggagatacccttcttgacattagctttggcaaagaatgttttgctaagtcccaaaaagcaattgcaacaaaaccaaaaattgacaagtgggaccgaattaaagagcttctgcatagccaaagaaactatcaataaagtaaacagacaacctatagaatgggagaaaatattcacaaactaagcatccaacaaaggtctaatgtccaaagtctataaggaacttaaatcaatagccaaaaaacaaataaccccattaaaaaatgggcaagggacattcacagacacttctgaaaggaagacttacaaatggccaacacacatatgaaaaaatactcatcatcactaatcagcgtagaaataaataatcaaaaccacaataagataccacccccaaccagtcagaatggctattattaaagtcaaacaagagacgatgctggtgaggctgcagagaaaagggaatgcttatacattgttggtgggaatgtaaattagttcagccatagtgggaagcagtttggagatttctcaaataacctaaaacagagttgccatttgacccactaatcccattgcttggtatatggccaaaagaaaatagatcattctaccaaaaagacacatgcactagtatgttcattgctgggctattcacagtagcaaagacatggaatcaacctaggtgcccattagtggtggattgtatacagaaattatggtacatatacatcatggaatactatgcagccataaaaaaatggaattatgtcctttacagcaacatggatggagatggaggccataatcctaagtgaatgaatgtagaagaccaaatactgcatgttttcacttataaattggagctaaatattgagaacacatgaacctaaacctggaaacaggagacactgtagactactagagggggaaagagaaaggaagatgtgactcaaaaaactacctattgggtattgtgctcactacatgggtgcaacacacccatgtagcaaacttgcatttgtactccagtacctaaaataaaagtacaacaaaaagtctcagtggaaaccattataaatgcaagatttgtattagcattaaattgcatcattcttggaagtaaatataaacaaacaaaacaaaaaaacaagcacatacagcagtctcccacttaactgtagttttccttttcaaggtttctgttaccagtggtcaatcacagtctgaaaatattaaatggaaaattctatacataaatttcattagtttcaaattgcttgtcattctgagtggtatgcatatattagtccattttcacactgctgtgaagaaataccagagactcggtaatttttgaagaaaaggaggtttaatagacacagttccacatggctggggagggctcacaatcatggcagaaggcaaaggagaagcaaaagcatgttttactaggtggcaggcaagagagcatgtgcaggggacatgccctttataaaaccatcagatcttgtgagacttattcactaccatgagaacagcaagggaaaaacccacctccatgattcatttacccccaccccccaacgggtccctcccacaacacgtggggattatgggagctacaattcatgatgagatttggatggggacacagccaaaccatatcaacacgtgatgaaatctgccatcttgctgtggcccaactggggtgtgaatcatccttttgttcagcgtatccatgctatagatcctacccacccatagcctcagttatcatatctattgttgcagtattgtagtgcttgtattcaagtcatccttattttactattcataatggccccaaagcacaagagtagtgatgctggaatttggatatgccaaagagaagctggaaagtgcttcctttaagtgaaaaggtgaaagttctcaacttaataaggaaagggaaactaatcacatgctgaagttgcaaaaatctgcagtaagactaaatttagccaagaaattgtggagaaggaaaacaaaatttgtgttagttttgtggttgcacctcaaaactgcaaaagtgatagccagagtgcgtgatgagtgactagttaagatggaaaaagcattaaatttatggatggaaaccatgaatagaaagatgttctgattgatggcaattgggtttggtactatcctcggtttcaggtatccattggtgggtcttggaatgtattcctctgcagataaagagggactactgtacataataaaagctttgaagaaaacatattctgataatgtgataaagcatgacaagcatgagggttggtgagcagtaatagaaaagagaaggaacatgaagattgacctgagagtagaccaatatctagaggataagaagacagggaggcaccaggaaagggaactgagaaggagcagcctgtgaggtagcgaaaatcaagtaagtagttcttagcaaatgtttatgtcactgaagaatgttaagcccaggagtgacctacctgatcaaatggatgctttcaggaagcttcgccctggttgccaagggggcaggactagagcagggtaagagcagaggcagagaaaccatttaatgggctgttgctgtgacgtgagaagtaaggactgcttggactatgattatagcagtagatgtggtaaaggtagctggatctgggatatatttcaaaggtaatgtgcaaaaaatggtagtacacagaagatttactgatggattcaatattggatgtgagggaaagagaactgggcgatctactttagatcaatgctacagaaaatattcatctgaaattttgctatctggtctgtaacaacatgagaagcttgggccaaaatgtaaatcacatttttttccatggcaagattctttcaaggaaggaagtacattgatttacattctagcacagtcccttatcttgtcgtagactggaaggcacttccagacagcctcatatgcagatcttacattgcagcattgaattagatgaagtcatcagtgaaagccattattaccaagtggtttatccagtcccattcttgaagaattgctgattttgtcattgtacaggagtgtcgtggttgccaacattacttggaactgcacacagataagttataacatactttgtggagcaatgccttcttaaacttttgtgtcttgggttattttgtgctgctataacagaatatctgagactggataatttatgaagaacagaaatttattctctctcatgattcttggaggctggaaagtccaagatcaaggcttcatctggtgagggcctttttactgtatcctcacgtggcagaagacagaagggcaagagagggacaaactctttgtccttacatggcaaaagggcaaaagacagaacccattcctccaagccctttcatagaggcactaatccattcgtgaggttggagctttcatgacctaaacacttcccaaaacaccctgtctcccaacacttttgtattggggataaagcttccaacaaatgaattttgggggacacattcagaccatagcattatgatttctagattttcatatgacagtttaatttttttttttttttttttttggtaagtaggcaaatagaataagctgaggaaaacatttttttttaaaaagtcaattactttgtgtttatgaagtagggtcacagggtatattaggccaatcttgcattgcaataaagaaaggccagggacaatggcttaaatgtctgtagtcccgtctgtattcctggcactttgggaggccgaggcgggcagataatgaggtcaggaattcaaaaccagcttggccaacatggtgaaaccccgtctcttaaagaaacaattagccgggtgtggtggcatgtgcctgtgatcccagctacttgggaggctgaggcaggagaattaacgtgaacttgggaggcagaggttgtggtgagccgagatgcaccattgcactccaacttgggcgacagggcaagactctgtctcaaaaaaaaaaaaaaaaaaaagaaagaaagaaatacctgagactgggtaatttataacgaagaggttagctgtctcagggttctgcagactttataggaagcatggtgctggcctcttctcagcttctggggaggactcaggaagcttacaatcatggcagaagatgaagggggagtaagcacatcacatggcagatgcaggagagagacagagagacagaaagagagagagaaaggtgccaaacacttttaaataaccaaatgtcatgggaactcactatcacaaagacaacaccaagccatgaaggatctgcctccatgatcacctcccaccaggccccacctccagcactggggattacaattcaacatgagatttgggcagggacaaacagccaaaccatatcacagggtaactcaagcaaacccttacttgttcttgaaaacttaactcatgtgccacttttatgcggcctttcatatcttttaaccattctacatgtttttcctttgtgttttcataacaatctgtgtattttaccattatcatagcattattataaatcaagaatagttgacttacctttacctgcctcctcctaaactggaagcaagtagaaggaagactgtgtcttataacttcagtacctaataggatgtatagaatattgtagatatttaattaaatccttacaagctaagtgatgtgatcttaatttcaaggaacaaaaggataattgtgtacactgctgggcataatggttagcacttaactttggggtaactaccaaggcaaagccttcattaggctaatgacagtccaaggtaaatgatatcagttgcaacctcaaatataaggataagaggttttaggatttaaatgaggattacacattggacttaaccatctctattaaaagagagcaactggcatgagtgatagtgcttcaaaaataaaggacattatagtatatattgtgtatatatacctacatatacactgtatatatgtctatcatatatatgtgatgtatacatattataatgtatacatataataacctcattgtcacgttatacaacatgttatgcacgactcattatatgcataactcattagataatgttaccataagatttgaggtgctgggatctagtaatttttttctcttatttgctttagtatcagctggagttcagaagtggtatttggcaaaacctctgagaatctaaagagttgattatagtttacaagctgaccagttaccatccagtgcatctaggtttcttaacaaatcacaatttgtgaagctacggtgttttccattcaagagattttttgaacatctaccatgtgaaaaagtaccaggtgccattaaagtgctaggcactgtaggggaatagaaagatgaattacacatgaatcttgtccttagggaagagtgagatgaaatatctgccatttctttgttgcacatacctccacatactgaaggataatgcaaactgaacctctgtcctgaagagtgagtcatgcttccttggtggagatctcagagcctggaaagtcttctaacctgacagtgtcatgtctgttcttcccactgattgttcccagaagtggctgctttcttcaattcttgaaattgttcctgtaggtgtaccactcattaggaaagatcccaactatctcagcacttttcaaagccagtgttgtttgaagtctcctgctggttgtcccaacctgcagttcttcgagtctcatgggcttataatcaacttgcactgtactcccagtcccttctcatttccttgttttgccctgaagcaatcaattgttctatcaactttcgcttagctacaggtgagttctccaaagatctctttcttaccctgttcctaaaagcaggcataaaaagaattagtgatcgcctcaggctcttttaggtattgataatgatgatgatagtactaataatgatattagtaatatgtattgagggctaaaaataggtgagttcccattctaagtgattggcagattttttctcatttgttccttgtaactgtggaaggaagatggcattattattacattttaagataagtaacctagtcaaagagaagttaagttcttgcctatcaccttcctcatttcttagcaccacctataaaaccagccccatattgagttctggttttctcataagcttcctatgattgactgaactctagtgatcacctgtttgtgttgatgaatagtagtaaggccagtgtacatattagggactaaatatcatctctggctgtcatgctctccttggacaagcagtgaatgtttgtatggttcttgagcttgtatcaaaggctgaggcaggtttaagagaggaaagataacactggaacaagagtagtctcaggttatgacacctgtctttgcccatgctagtatgagtgtttctaatttttgtcttataatggtcatgtatttattttgaactgaattggtaacagatgctgtatgaatattgcttttccttgaaaaagttagtcttcatctctaggaggagtccaagcacaccctagagctgtgatggtaacgctactcaacattatcactgctgtttagaggcacttaggcctgaaactgtatgtgtttcatgtgcattatttcacttaatcctcataaaaacctcaggaggttgattccactgtattatgaatacagtaatctgtatatagcaatccgtgtggctgattactcattcctttataaaatgacttgaacctcatgactgggaagacattagatgaatggactcagattttattttattttattttactttgtctttgattatataattttattttatcttatatcagatatattattttttcttggattagataattttcctaaggaggaggatcctaccacttactaaatacagtaatgtgtcccttaatgacagggcagcattctgagaaatgcatctttagttgatttcattgttatgtgaacatcatagagtgtgcttacacaaacctagatggtacagcccattatacaccttggctatatggtatagactattgttcctagactacaaatctgtacagtacgttattgtaccgaatactgtaggcagttgtaacacaatggtaagtatttgtgtatctaaatattgctaaacatagaaaaggtatagtaaaaacacagtattataatcttatgggaccactgtcttatatgccatacatagttgactaaaatgtcatcatgccatgtatgactgtacctgctgtttgggggacactatcctagctgtttccaaatagtttcttatttctaccaaccttatgatttaggttaaatatggatttagaatgtgttttcaaacatgcacaactctttgcctaagaacaccttgggaaaggagtagggagaaatctataagataaaggaaatgaacaaaaagtggtgaggggacttaatgaatatggagcaaatgtttaacatggagaagagatctttgccagcaagctattgccctggcagatacataaactttatcctgtgggaggcaatgatctggcgacaaaccaaatgtaaaccttgcaaaggaatattgcaataaaattcggctggtagtcaacagcaatttttcttataataagtatgatttgtttctctgccttctctatcagatatgcttctgcttatttatgcataacaagtagggatgggggaaaaataagtccttacaataggaatctgtattagtctgttcttatgctgctaacaaagacatacccaagactgggtaatttataaagaaaaagaggtttaatggactcacagatccacatggctagagaggcctcacaatcatggcagaaggcaaaggatgagcaaaggcacatcttacatggaggcaggcaagagaacgtgtgccggggaactgccctttataaaaccatcagatcttgtgagacttattcactatcaagataatagcacaggaaaaacccgtccccatgattcagttacctcccacgacatgtggggattatgggagctacagttcaagatgagaatttgttggggacccagccagaccatatcagaatcaatcatgataataaagtctctgtctctataatgccgatgttttctgcagtattttatgaaagcgagtgggatggaatagaatgcagtggaatagaaaatatgcaaaggtggatactcagagccataaatattgacagatggaagatgcacatagctgatttgagctatagtgtcaaataatacttttttattgcaagaaaaactttctggaggaaaaaaaacaaaacaaataaacaaacaaacaaacaaaaaaccaccccagaacaaaagcaattgtgtttattggcagaaggataaaacctttactaatctgtccagattgaaacacgttcttttctttccccttcagtgaccctgaaaaacaaaacatgagaaagatgcatttatatatatatgtgtgtgtgtgtgtgtgtctatgtgtattttgtatgtatgtgtgtgttatatgtaataacattgcttatttaatctcacacatatacagatatacaatgagttgggataagctagacaatattgtacgttaacaatcaaaccccaaatctcagtgttttagaccacaaaagttcattgctcactcatgtgaacttactttatcactttgtgttcatcgcagattaactgcacctctcctttacctcatttcattctggactgaggctgacattgtagcctatacctgtaatactacctatcttttaacagagagaaagataagaacatggcagacctcatactagatttaagagcttctgctcacatgaatcaattctttctacatgtcattttgtcaaagcaacttaatgtcagcatgggacaagtatatataatcctcttgtagaaaatatttttgaatagtaatgcaagctgctacagtatagtagcacattagagtgatacacaaaactaatactgtatctgttggagagagtattggtgggtgttgaatgtgttgtagttttcagaatgtaattgtacccagggcaactgttccatctgatactaggtgtgtacttttttttccaggtggttggggtgatgttgatagtaacagaatcttgctttgtggcattagcctcatttattctcatatactctttctctttattcttcatattaatgtcattgcgacactatttctatattataaagttcactcccaatatttttaaatcaacagatacttattgaggactgactttgtgtcaggcaccttgccgcatgcttgactatatgttgatctcattcagaaacactgtttcttagtgatttaaggcctgaagtaaatagttaattttagataaaaaacacattgatgaaggactatagtgcatgaatgaaactacatcacagttttgtgggaagagacggacacgttgtagaaaatttcacagagtgcttgggaccatagttacagagaaagattgatgggattttgtcagaagtcaaggaagaagtggggtgaaagccttctaggcaaagaaatcagtataaagaagagcatataaatgtaaagcatgtctgagaaataaaactagttctttatagttatggtatagaatttggggaaagcataaagatacatctgaataaatgcaataagagaaattggagatatttgaaacaattcatcatctctatctagaaaggtcaatcttcctgaacttctgagtattctcactggcacctctgactgtgcagtctgacctcttcatttttactcacccttttcaattgagcagtgtcccagggtgagtcccatggttgctttgtatgtattaactttgattaatttgagtcctgcatttcccattttctatgactacctaagatttatacttcagcatctttattatggcttattccatttggatagagtgacctagctccaatgagtggcctaaaagatgaccctcctctaactttctcatgttgatttctatatttctgtccaacatatacaatgtctcctgttatactagatcctacagttaacgtgtttacaaaaatgaattaattcaacaaaatgagtcatttgcaacatgaaatgcaccgtgaatcattgtttttctgctgttctacaaatattcgacccaaggcattcaatgactcatgtgtggcataaggactgtgctgtacagacatttcagaaacagatcgaaaggtaacctgctaggaaaaccatcattgctttagttactttttcataaaagttagtggtatggatattgcacaagaagctcctgtgcattatctttttgaagagattcaattgaattgaggttgagaacactatgtatcaatgctttactttccactagggagaaacaatctcttcatacactgccttccagggtatatttctgcagaaattagttggacaatgttcttctttttcccaactctttttcatttttatgtctggattagatgatggatagtttgggtttagaactggaatatttcagagtgactcaaacccatatgttttaaaatgtgacaattttaggtacaaaaatgtaagtgataaaacgcacgtcatataaaagatgcggctataaaccagcatttttgactttcaatagtgttttggggggcataactgtaaaattgccccagaataagaacagtgaatgcattacctggagccaaagatttgaagaagcagcgcttgtcactgatagggtgttgtttataaattttgcagtcactttatatttcagctatgcttacgtactgatttcactacttagaaaattgagtcatttatttgagagttgaggtggcttccatgttatatatgcagaatacaacaactatttaaaattctaataatttgctttttctattttgattgatttcaatactcagtcagtaggaaaataaaaaagatgtatttgggctttgaaatttacagggactgggagctcagtcaggttttgaacttcaggtttaggcccatctaacttttgtaatgcagttgtgtagaagagcaaggtttgtattgaacaaacctgcctctgaatccctgctgtgatgcccttgttagcaaattttatccaatcaagacaccattgattgtaaatagtacccagactttagggatgcaaagaatctgataaatatatagtacctgtctgattttggtaagttaagtaataacctctttgaactttaatttccttatcagttaaaaaggtaagtgaataatggtattctcctcagaaagctttcaagatttatagagatattctgggagttatatgacagaataggtagaaatatcgagccttttttttcagggactcagtaaatgcctcagtgattgtagataggttgtttatatttcaaataaaaacccttttaggaatgagaaataaaatgtagtcttgaccatcttttccttctaaaagaacataaaagtatcacgagtgagaattaaaagcagatcagataaaaacaaaagtcaattttgttaaattactgataatagggataagaaaggagtaaccaaagaaagacctgtctacttatagcaagcttgaagtcacctgggagtgttggcctcctaactttataaagagttcatggccatctgctgctattttctagtctattgtcagttttctttgtcccaggttctagaatcattcttcagtcaaaataacttcctactatatttgaattcaacaatttgttttcccaaaatattcagtttaataagtttcatagtcaatggtggatctatgccttaaaaaaaaatcaataatcagccgagcgcggtggctcacgcctgtaatcccagcactttgggaggccgaggcgggtggatcacgaggtcaggagatcgagatcatcctggctaacacggtgaaaccccgtctctactaaaaatacaaaaagaaattaagcccggcgtggtggcgggcacctgtagtcccagctactcgggaggctgaggcaggggaatggtgtgaacccgggaggcggagcttgcagtgagcttagatcgcgccagtgcactccagcctgggcgacagagcaagatgctgtctcaaaaaaaaaaaaaacaagaatcgtttagacattatgacctaggtataatataatgacagagaaaatgtaatggcagtaaaatataatgacagagaaaaaaagttataaattgggtatttgtggggaagaaagggaaaaacaagcatacctgtttgggtttttttgtttgtttgtttgtttttttgagacagagtctcgctctgtcacccaggctggagtacagtggcgccatctcggctcactgcaagctccgcctcccaggttcatgccattctcctgcctcggcctcccgagtagctgggactacaggcgcccgccaccaggcccggctaattttttttgtatttttagtagagacggggtttcaccgtgttagccaggatggtctcaatctcctgacctcgtgatccatccgccttggcctcccaaagtgctgggattacaggcgtgagccagcgcacctggccgcaaacctgttttttttttttaaattacagatatgaaaacgaaagccctgaataagttagcctaatatttcagtttttctatatagattggctgaatttttctttaacttttagaaggcatgcatttcacatacatacagaatcaactttattggatgcttactctgccaggaacttggcaatttttttttctttctttttttttttttttttttttttgagtcagagtctcactctgtcacccaggctggagtgcactggtgtgatctaggctcactgcaagctccgcctcccagggtcacaccattctcctgcctcagcctcccgagtagcccgccaccacgcccggctaattttttgtatttttagtagagacggggtttcactgtgttagccaggatgatcttggtctcctgacctcatgatccacccgccttggcctcccaaagtgctgggattacaggtgtgagctaccgagcccggccggaacttggcaatttgtataccttacttcattcaatcattcaaggaaacctactaaatagattaaaaaccaggattcaaagtcaccgttggcatagcgtttatggtacacatgctcaaaacagaaaaacctacataatggaatagtttatatattggaataaaatgtataacaataaacttgttttaattaaaatttaactaaatattttaaaattggtgtggcttcctttccaatacccttcaggtaagtatatttgtgtatgtgtttctccttccaaaattgtgatatctaccagtgatttaataagtatcatatgtatttcagtaatttttcgcttaagacaaaagacatcattattcacttctctcttttttagctatgcaaattattaacaaattaatctgtaaatagtaaaaaacactaaaatgccttatgtatttcattaaataacattgccttagttttaattactttcacaggaaaattcattcaatcaagtcttttctgactagtgattgtaatcctgactaaatgtgtgttttatatcaaatcctctctaatttagtttgttactgtaccacgttttaatctgtctctcatctctaagtggtaactggactctatgctaaaccaaaatcttgactcatcacctcaaattcctaaatatttatttatttttttaaaggcaaactggattctttcttttgcttgaagacatattttcttggaaaagtgttttgaatttgatcatttcttctgtctgaagtcaaagcttagaattatatctaataagtaaattgtcagactagccagctattctcaaaaaatgttggacatatcattgtgcattttaatttgaagtcagatgaatccacagatttaaaaatctttgagaaccagaagttcattttgttttaaaggctctaagccagagctgtctactagaaatataatgtgagccacatatataattttaaattttctagtagcaacattaaaaaagtaaaaagaagtaggtgaaattatttgtaacaatacattttatctagctcaacgtgtcaaaaatattttcttttcaatttgtaaggaatacaaaaaagcattactgcaatttaatttaacatttcttagattaagtcttcaaaatgtggtatatattttaaatttacagcattatctcaaattagcctctttttaagggctcagtagccacatatggctagtggtaccctattggacagctcaggtctatttgatggaacatatattggcaggttctaccttttactcaagggaattttagtttcatggttaattggcgttaattatcagtagtaatcataatgtaactcaccatagttattactttagctaatatatgggcagaagtccacatgcctagtttaaataattccttatttttggttgagaaaaagtataaatatttatatcaaaattacctttctacatgacacttaaagtagtataatattttataaagaaaagaataaaaactgggttcagagattttgtgattttgctttccaaattagaagaaattaggtccaggaaaactattatgtagagaagaatcatattcactgaaattgaagtgttacactactttctttgcccatgcactccatcaatgaattgtattttcatcatttgacttttatgtttcattctttttttggtagccaaatttgtgttaacaagttttcttaatctccaaaatatattttataaagagataataaaaaagttgatgtgtatttacagcttaaggtccatcatgggtgaaagtacactttttcaaactttactttggagagtcaaatttagctaataactgcttttaagggttaacatttctaggtaaggcaaacactcaaatttaaattagtttaggagacagatttaaataattcttttcatgactttgctaatatctcactacaataaaaatgatctttgatctatttgtattaacttgggaaacatttgattaaaataatatttaatgatttatttagctgtgtggatggatgataattttctacattcatttttaattccatgcatccccaaaatacacacccacccattatcctctgcagtggctgcttctcatgtttttttatctgccactgttccctttgatttctccaggcccaatatctcttcctagcagtgttctgtatctaagattcaatttctgttttatgtatctgcttcattaccattatgtaactatattccttggtacttccttctgttttgtaacatctaacgaggatagagagcattttatttgctatttctaactcaaagccacagttttatactagagaaaaaactgaggattctttgttcttcttaaatacctcaggagaggatataagagactacccaattgacttagatttttagaaagcaacatgtttgagttatttcttatttttaggttacccttcttgtgcatttccctccattccttcagagctcttttttttttcattaaaatgcagtatgaatctgattatctagattttgaagagccagggatactattatacacattagtttaagttgcactgagatggttctcctctgggaacatctaaggaataattttcctgatggctggggcaatattagacataagtgttcagatttaatctgcacgtaagattcaacaattttggattcacaaagcactgatgtacaaatccttaaagttaataattttatttcattcttatatcataatacattgggttttaaagcttccggtatccattatatcttgatctcattaaacatacacttaacctgtgactagaaagcaggtaatagggaggagccagctccctattaaaatagttcaagatatttaccaaaagcaaatggaaagctttgtttacaaaaatagctgttcatgatgttcacagcagttttaattgtaatagctaaaaactaaaaaaaaaaaatcccaaacaagttttacaaattgtggtatattcataaaatggaatactacttagcaatacagagaaaatggtgtactgttatacacaaaaacatggatgtctccatgactttactttgagtgaaaaaatagtacattttgtatgattcgatttttatcaatttctagaacagacatcagaagaggagttacttatgggctaaaagggaaagcaagagaactttctggagtaatggagatgttctatttcttgattgggatgttggttacatggttgtgtacaactgctaacccttacccaactctacacttggtaactgtgcattttgctctgtgtagattttatgtagattttcaaaatagattgtagatgttaacaagcttgtgataataaaggaaaatgttagccagccaaagggagagaaataaaaaggattgccaagatggagggagaactagaagcacttgtagcttcaccttacctagcaggagaaggggataccaactctacataaatttctaaaaataataacaggattatcaacaattgggaaaagaaggaaggaatagcatgaatcatcaagaaacagcattttattcagagttggtagccaacaagtgacctaaaataagaaaacgttataggaggttgcttcctgggaatggtatgtgaagggaggcgtgggcatgcctccttttcagtataagtttgtccatggatcaaatatgttactgtgtatacacagtgctttgatgaaaataacattttaaagatgttatgatttccccattgtccccaggataacattcgaaagcttcaatccttcatggtctggcgtccccttgcccctctagccttatatttgctagtcctttttcctcctcacactcctcatccacccattgtcttcgggtttccagaatgtgtcttactctgtttcatcctgggctttttcctataatgttttctcaggttcaaacacttaactcttcggttcccatactcactggcctaagggatttttttgtccttttttttttgttgttctgttttaatctgtgtgtatctacctccagaatgaaagcatcctaagggcaggaaccctatgtggatcttttggaaggttgcatccaaaccagctataacaggtacctagggctgtagttggttcccagtcatatatttaaaatgagtacatagtttgacattttaaaatagtagcatgactttaagaagcaatgtaagtgtcgaattctaaatctttccctgtttgtagacagatctcaagatgttaggtcaatggctacaaaatcttggagtgatatttctgaggatacagtaaaagcagtgattatcatatgtccattttctgaaaataaatgaggaccacttatattaatcaatgattttcagagaaatgaaaccaaaaggacacacacacacacacaaaaatggaaccaaaaggacacacacacacacaaacacacacacacatacacacacacagaaatttattaaaagagagattggctcagatgattatggagactgagaagtttcacaatctgttgtctgcaagctgggggcccaggaaagccagtggtatagtttcaatcaaggacagagggcctgaggaccatggggctgatggtgttaagtcctggtctgagtttaaaggcctgagaactaaaggcactaatgtcccaggttgtcagaatttccatctcaaggagacagcaaatttgcccttcctccacctttttgtttatgtaggccctcagtgattggagggtgactgcgcacattggtgaagtggtgaagtgatcttctttactcaatctgccgattcaaatgttaatcttttccagaaacgcccacacagacacatctagaaataatgttttgccagctatctgggcattctttagcctggtcaaattgacacataaaattaaacatcacacctctttaggttaatatcccaatactgacctggtcagacctaggagaagggcccaagaattccttgccttccctgtgtattagctggttcctcgctattaatggctttctagttagatcaaaatccaaagaaagaaactgcaggtgaatatctaaacatcaggaagcttttacatgatcgcctattgattaatgcttaaaagctacttatttaaaaatgctagaatgcattagaacattctctcttgcataaactactgtgtagtactagagatctacacaaaataaaattaaaaatcagctaaatgtgtacatttacataggaaaatattcaatatttacttgctttttatccttatattttataaattgttggcaaagcagacataaatagttctcagcttgacacaatatgtgacttaatttgtagtactcaatgaaaagctctggtactactggaggatttataagttaaattttaattttttttttgtttttttttgagacagggtcttgctctgtcatacaggctgggctgcagtggcacaatcatggctcactgcagcctggcactcctgtgttcaagagatcctcctgcgtcagcctgacaagtagctaggaacaaggtgtgtaccattatgcccagctaattacattttttatttttggtagagatgagctctcactatgttgcctaagctggcctcaaactctggggctcacgtgatcctcctgcttcagcctcccatagtattgagattacaggtgtgagcactgctcccagctaaattcttatattgagcaaaacatcttcagaaaaataaaatcaattctgtactaatcatagcaaaattatctttcataaccttacatacacatcttaaataattatatatgtttgtgtgtatctatcatatatacgacatttacatagacgataaattagcaggaacccactccaggatacgtgagctatttatagccattttagtggacctattatcagtcactttggttagctttcatatgagtatttgaaactatatatggatctctattaatataaaaattagttattgaagacttttctgcctgagaaaaatgaacaaaatgaatatttcaatcttagagcagtaaattattttttcctttgagagataaaatttgttttcacatgtggtaaaattttctaatattttattaaatataaaattttagtcatctttggacaaaccaatagctttgctgctttaaatctaaattttaaaataaaaatatatatacacatatataaatatataaaggtatatgtatatacacatatatatatttgtccacatatttattgagcttgagggtttgtaattttacaaatgtttaagaaaatgtaccattactctgtccctttcttcccacctctctattcttattccttagggaaaccatgttcaacatttttagctgctttttcttccggtttacctctgtgattctgaatatcttcattttttatgtttttgttttgcatattgtcttctgatttcctactgtggaaaatgggaatgattttaaatatatattttcctatatttttcagttagtcataaattttcagttaaatcaatattagtactcatattatggctataaaaatgttatattttattatatgattacatttctttaacaatattttgtttttcctggagttaataattggtacagttcctgtgaccttttttttttttttgtgaactctttcctaagctctctatcagaaatataaacaacttctcaataactttgttaaaatcaggtattctgtcatggctttggttttagttttgctttcctggagacattcctcagacagttgtttcctggttgtctgccctcctgttccaatctggggtggctgctctgtaattctgctgcgccactgtcatgcaccatttcccttcactgtcatcctgacaattctctttgcttttctcctgtcttggattttctccccttggggtttcatgtcttcctttttcttagttttcttcctaattttagtcaggcatatcctcttataacttctagagaaggcttccataattgagagtatacatttgtgagatatcacatggtctgaaaatgcctttattctaatctcacatttgattgatagtataataggtacaggaatataggttagaaataagttcctcctaaattttgaaagcatttcttcattttcttctagcactcaattattgagaggtgtgatgctattctgctacctaacattttgttgttggtctgctttttacaattgctttattttctttgattgaagcttttagggatttctgtttgtcctcagtgttccaaaattttacatttttgtgcctcaggttggatcatttttttatccattgtgtaaaatacttagtgaatcctttctatcttggtgattcatgtacttcagttctagtgtattttctggaatattgtctgatgaataccttggttttctgtttgacatttctggagctcctacaatatgtgtattggaccatcttgatcagtcttctaattttcttattatttatctctaatttttatctttttctcattatttttctactttgtgagtgtgatttcttcagctttattttctaattcctttatgggatgagttatttctgctcttcttttaaatttcaacgataattttttaatagtatcctgttcttgtttcatgtttgcatgtcttcttatatcggttatagtgttctaaagttttcctctgttcttgcattgttcctttttttggtttcttttgtctctgtctgaattgtccattcatatttgcaaatcaaggatttaaaagctaattagataactggtatttatgtgtagaacttgttgagtggtaagcattactattttatcacttgttcactttatttggtatatttagtttatatactaaactatcattaattctaggtatttttgtcctgtgtgtgttaatttactcagaaaggaatattctgaactcgttcctactagactattggtttaactttttagaagacccagctgctattgtcttactgggtggaggaggtgtagtcatctggttgcttagggtagggattggatctaagagcctatatgctttttagatgtttaaccaaccatttttctcagccctacctataccactgccttcaaaaatacaaatatgtgccctattcctgcacccttttctgatttctgtcaagtgaatttgcttgttaattggctatttctcttccctacccattcttagcattgaactttcagcttcatctgctctgctaagttagttgttttttatcttttcactttccggcatttataatttgcaccctgtctctccctccctgcctcttctctctgttattgtttcccttcttattctcattgttcttttgggcctctgacttttatatcctcatcttcacctacacccccacccccctgcccacagacctttttttcacttgtgtgtgtagttataggagggagcagaggctaacttgtttgactgggagtcttaacgattttaagagattttaaagattgaattttatatgatttcagtgaaataaactaaagcgatttgaattaaatatgtcttgaacatacacctcctgctctaccctcttttgcttcttgtgcagtagttaacaatcatagtaccaaattctaccctgagtacattaagataaacagccaagttcaatctcaagtcagcccaaggccagcttcagtttcaatgggggatcatttgtagtcaaaaatagagagcagtcttagaagagtgtcctcagggtatggtggctggcttccgccagagtgagcaagacgggaaaacgaggcagaagccacagtgtcatctgtgccctggcctcagatgtcacatttcttcattaattcagcatactattaattacagagataggctagtcaattcactgtggaagaggtggtacagggatatgaatactcagaggcaaaaatcaccgagggccatattggaagttagctaccacactggatgtttactcaggctccctcacttattaagttactctcagatccaagcttgaatgactcaggttgttgcacctatatgaattaagtcttatggtgttacttgtgaagaatgaaaataacaaatgtcagttttttgaaagccatttataaagcttaaattaaaaccccaacttgtgtaatttgttgtatattattaatacagtcatcagctaactaagaccctataaattggcccaacataaaattatccttcaagatgctaataaagggtatccacattgtgtatgtgtccagtgtttcatctgggtaggccaggaatcagatgacacccaaatagggacttctgtttggaagggctaatgttttgaaccacatagtatgtattttggaaggactttcttattaagaaaagtgattattagaaacgtgattataaggagcatcagagatcacttaccaatgtgaaattttaggaggatagagagcatctttatttttttctccagtagtcatttcttatttttttttaatcctaatactctaagtagtcacaatgatatgtgaatcattgcatgatgagacaataccggcttctctttttttgagaaataatttctattatcatgactgcttttgaggttggtgaagatttaatattgccttacatcatgccattgaaactacacattcaactttgggattttaaaaattctctaaatatggacttttagggggtaagggagtgagagagttgtaatttccattttaagtccactagaaaccaatataattagggtacagcatattctgtcctgtagtagattttagaaacatgcaaatgaagcacactgttttccatggttgtttgattttcatttgggtgttttgaatttaatgagattttcctgatttagtgaccagtaagctgacaccatgttttactgtggaaggatattttttttcttttaataagcacagcaattcattgcatgatacaccattgctgttttgtgatgaggaagaacctaccaatccaatgtacgtttattctccttttgctaggacaaaatgaatttgtccagccatatcatagcctagagatatattatttctgtggcaggaatccattgccaaaaataaaaaaaaaattatggaactaaaacagttcatgtaggtaggaagtgtaagactcactgccatatgctgttctcatcctatcacactcaacattgaattagttgaaattttaacatgtaccttcatttctctgtagcagaaactttctgaaaactgaagaggagatcaatcataccattattgttactggaaattaaagaagaatgtttttctcatctttttaattggagaatcaaaagaagtgtattgaatcctggactatgtttccacggaactagttttaataggtttcatgtaagaaaaacaattctgtcatcatacacattcagagaattgtgaatctgtaaacaaagttaaacagacttccttactgcaggtcaccagagagcacatacgcagcctgcatgcccaaaagggagcttttatattaatccaagattgcagggacccttttttcctctaggagtatgttatgatgttagtgtctatggaataaaatctgggaaacacctttgtaggtaattttcactcattgcaaaccgaagttcactttggttcttgatattcttgatcaagaattgatctctaacaggtgcttattatgggccaccataccattttcaccagtacttctctaattctatggagaaggcaatatttgatatgttaattagtgatgaagctgactataatatgcttgagtctaaaattaggcataattacttctatatataagacactgagcacagtttgcctaagctgaagttaaatgtgttgagaatttgaattcccttttataggctatttacctcagtaacatttaaaatatttatggaatgaatcatccagatttactctatgctaggcagagctttaggaacatgaacttataaatgatgttgagattgtggtttaaacaggctcagtaaactagtccagggtcccatggctggtaacgtagtgaagcaggtactcaaacccagttcattctgacttcacacagctcctaactacctctggcatatataggcatagatagaatgcaattaataataattgtttagccttatcagagaacaagtatcctaatttaagtaaaaataatgggattttatctgcattttaaaaatgatgatgtatattagagcataacggtatagacactcagaattttatctccgtgatgacattggctttaacagtagtgcttagtgagtaagtatccccgaataattagatgaagataatataaaaggtgtatttctaagcaaactgttttaagcatgtggaagtatattttatcagaggtttagttttttttttgtaaacttgtcgagtgggcgtttatttgagaggcattgtagtagaaagggtcctaggctttttaagtttccatttctccacttactagatatcctattattagtatattttgctcaagttttttgtttgtttgtttgtttttgttttacctctttggagcctgaatttccttcaatttaaaatggtaaggtagtatgtatttcaaaggattgttgtaaatattaaatgaaataacttatataaaacacataggacaaggcacaaagctatcacatttttcttcccgttttctctatttcagtaatatttaaaatttttatttgtcattgaaattaactcatttaatatatatgttaaatcccaagataaaatatcctagaccttctacaaccagatgttatcctcctaacaaactaatttgtagttgaacatctgtttaaagcctggctaaaaattgccttaaaaatccttcttttctgatactaagacaatgtttttactcatttaatatttcagaaatgttcagaaaagcggttattcattcactagtgggacttgcaatcagtggcaccttagaatggaagaaatatagcagaaacatactgggtgatgcagcaaagaaatgtgttgaaatctattacatatgaattgttattttctccatttcgtagaaaggaaactgaagttccaaacacctgtgtagcagtgggtagagaaaagactcggattccacttttcagagaagatcatctctacttacacttaacacaagtccttaattccacaggagtaaatccggatgagccaaattggaaacaagaggcatgtggagtagatcagaaaacacttttttcacgtgtgtgtattatttttaaacttcgacatgaactaaagaataatcatgaaatgtatttcttcaaaagcctttaaaaacagataatctataggttagaccatttagagaggtaattcgtctgggataatttgtgtaactttctaacagtttttgtcaaataaaaaactgtagtaagtcgacagtgcattcatgatgtgcattcactgatgtggctcaacattggtaacagtatgtagagaagaatctgacaatttcagaaatataggcacacatatcagatgattatatcaatgcaaacctgttgctttggttatatgagggtacacttcaaaaatacacaactcaaagcttttttctttttctctgtcaaaatagacaaacccaggttaataaaaatagccagggagttcagtctcccaggaagagcagtctgaagaatgatgacatacattgtgccttgaaggctacaatcaatctttattgaaaagaatctacactgaggacaggcagggctttttggacattcctacctcattacattttgcatttatctgccatcttcttacctctgttggtcattgagggttataaccatttacttagagtgattttttctttttacaaatgaagataaatgagcctacaatattaaatcacatccttgtttcctcattttatttcggtccctgtaaagattaaatgttgaacttttttctttaaaacttaagtaaaacattgggctaggaaaggttagtggcttaatgtatttgtttttctctctttttttctatctatctatctatctatctatcatctatctatctatctatctatctatctatctatctatctatctatctatctatctattgctcgaaagagagagggagagagagatgtaattttttgtgcaagtagaaattctaagtttaaggtctgattttatttatttatttacttatttatttaatttatttatttagggacagagttttgctcctgttgccctggctggagtgcagtgacgcaatctcggctcactgaaaccctcgcctcccgggttcaagtgattctcctgcctcagcctcctgagtagctgggattacaggcatgtgtcaccatgcccagctaattttgaattttaagagcaatagtttgcagactgggagcctcaaaactgaaaaatggcatcaagcctcaattctacagcagttacagcacagttgacagggaataaaagaggaagtgtgttcacctttgtcgtgattggctgtcatgttttcttttttaaggcaaatagagctatttaagctgatttgtctatagctgattgatttaatttcactgaatcatgctgtgaggggcaaaaacataacgcttgcatttttatgtttagggttaggatttccaggaaattgggatgacctaaattttgcttaagtgtctatgggtggttgaccatgaggtatccaaacagtagcccccattttcatttatttatttttagcaataggaatacaggaaactataccaaatttaggcaactatttactaaaggaaaaccaaaaaagggtatgagcccattactttgttcagtaaggtctggttttaaatatcgatcttattaatgctttttgcataaagtgtaaccttaatgtgtatttttccttgcttcatctccgaggtgactttctagttaggacaccattggatcaaggtgctcaaaaacaggggggcccctctcccattacacagcacagtgcttctgggtatgtcctgtttctggcagcttgaggatctgactgacatagcaggatgcttcagaatatctttttgtaggaaaactctctctcattctctctctacttcatctgttctaactaaattccaaaaaaaaaaaacaaaaaggagtgggagagtttgtattgttcttctgaaaataaaaacttagaaaatagctttttttggtattcagccacaataatgtgcattaatattccaatcttccttctgctcatgaaaaaggacacagaggaaagactaacaaagaaaataaacctgtaaagaatagtattgaatgtgagaagataaaattaatatattcctaatgaccatgacaggaaataatgatagcattaaactgtagtgtcttttccataagttttagatatactgggcatatgtgatgcttattatacacgtaggcatctcaagcagaatttaaccttgagaataattgttaacaaaattgattattaaaaaaaatcaatggctttgttatttgagtgtaaacacgtacacaaaaatgaagagccaaaagttagtggttacgatttctctcttgttccctgccctagaactgagttgttaaaatccaaaacaatatgctttttaaaagctatgttgtatagtatttattgcagctatcatttgcttcaactttaacctaaaggcaaagtcatggtaatctcttccttgctcagaaatctttggcatctcctcagagcctcgaggaaaatgaatttttttgtatggtattcaaggcttcacaaagatctcccttgctagcctcttccccactccttccaccctgcttcctatgttcacaaagttctctgccttgcctcaaatgttatagatttcagtcttctttgaaataccctcttaacacttctctgcttagcaaattcctattattctcaagggtcagctcaaatttaccctttagtgaggagggcatcttgcattcttctttcttctgacttctggccaaattactttcttcctcccttgcattccctggctcctttgttcatatcacaagtttggcttagattacacaattattataagatacttgcttttctgctagtttcttagtcttttggagtgcagatacagtgttatttatcttttaatcattagagcccagtatggtaaaggagagaaataaatgaattgaatcataggtctatctccagatgttaaaagtcattgtaataaatgagggagaaaatatccaaaatgtttttcttctcctttatctgagtctatcaatcttattgcttaagtggatggactatttgaatagttgatatttctaattagcttgtgtattccaaaggtaatttacgttgctcctgtgttttaccattaatcccaaactgtggacatcataaagatgccttacaaaattaatttaataactagctaaatatagcataccattttcttcaaactgattgcttcatgggttcttatttccatgagatcttctagcagaagtaatttcgggttggtgtctatctgaaagccttctgtctagcagatagcattgaagtggagctttccttaaagaggacagaaaagcagactgtcttccctctttgccgcagagccagaaggacagggtgaaaagtgtctttcctttgactaaagagaatcacattccactaaaggcagcccatttcagactgattattggccaactttatatccagaaggaaagcaatttaacagaaaaggagtagtctttcagagaattaaattttttgtctagatttggactgaagaaacaaggcatattgaggtagagcaattaaagctcttttggtctagaagagaaaatcaaactctaagggaattttaaaagccctttttgttgtgaaatatgacagtttgcagaagcctgttcttcttccacttaccctttcaatgaggaaacttatcttcctgacaaaaattgcattaagaagcagctgcagccgttttcccgtaggcagcattctgagggaatatttgagagaataactccccaaagataaatgggttcctcagtagccttgggcaggaggaataaaggcgattctttatttttcatactgtgggcacttctgtgaatttgctggttagcccaagctaaaagtcaacacaactttttgattaggaatagttgcaggtcagcagtactttttgttttgaagttttgcagcacagtcctgtgggtggttatggttcttttctctgtttccaagtttgcagaagtttgagaggtgaccttttgtggactggaggaggctgagaaactgagtgaagtgcacactgtatacccctttgccgagaaattgtctctcaggctgcagaccttagagcagtggtaactatgattgacatgtaatgatgcattcaaagcacacatcacatagcaagaccaaatcttcattctgaagtcgtatctaagtgctaagtcctcattctgaagttctgaatgaagtttagcccctcattctgaagtgccaacattcatcttcacaatgatctgtgactctcctcaccttctgttgctttcttcccccattgtccctacagatctttccttcactgggttacatccactcctgcgtcaggatctccttgtcgtagacttaggtttctccaagtatttgtcccctttacctctggttagcccacagtgacaaggcagcaaaactcatttttataaggggtggagggggaatcgttgtgataacttaccctttaacatttgtctcataggctcataattccattactttgcctgtaatagtggtaagtaaatatgcccttctgtttaggttttagggcaaagtagtattttagcagttaagaatttactgagcatattcctcttcacaaataatttattggtgattaagtataaaattaccctgtgtttttaattcttattttctcccatctcttttctcttctctttttctctcattcttctttttttggggggggcggggacagagtcttgctctgttgcccaggctggagtgcagtgacacaatctcggctcactgcagtctctgcctcctgggttcaagtgattcttgtgcctcagcctcccgagttcctgggattacaggcatgtaccaccatgcctagctaatttttgtattttttgttgagacatggttttgccatgttggccagactggtctcaaactcctggcctcaagtgatccacctgcctcggcctcccaaagtgctgggattacaggcatgagccaccacgcctagcctctttctctctcattcttggtagcagttattacctatacctttttgaatgctgaaagtattgattaatgctcgtaagacttagtaacacaaatctgtagtacttcatgtaacaagagcaaatgtttttcaaatctattataggaaccattttatctctacaaataagaagttaaaaaatagtttttaggtaatatgaaaagtaatttgaaatcacaatttaacaaaacagggccttgtgaaaaattttgtttgttgataggacaactgatgttaaataaatttttccacattaaatgttttcagttgactatgtttcaaagaaaaaatgtaatggattttatagtatatagtatagattttatactacaactaatgaaatggaacctttatggtgaggagggtccttggacagtggacgtgtgactggtagtaacatgtggtccaaagtgcagcagggacagataggagacagaagtcagaggttgatgttgaggtaggggtggtggtggtagtggtagtggtggaggaggacacagatgggccaaacagccctacatttgacaccagtttctgaatggtgttaagactatttagtaaagatgttgagtgagcagtgagaagtaagagcgaggagcgagaagaaaattagagtgtagcccctccttcgcattcaagcttccccaccaactaaaggcacagcctccagattctaccccaaagtgcattctgactgatgttataaattgcttttgcttcccttcataaggcggtattttctagaatgataattaatgatagagttgtaaaacaatcttaaacaattaattgggaactatcaaataagtatctgtgatgtttgatgttggaaaaacatgatatgaaccttttgctgaggaggccctagtttactagttgaaagataaatttgtcatgacatctcttaatacaactttatatatcttcattactcaattaaataaaaactcagcaataacaaaactttattatatgagaaaataagaaaatagtatatgatgcagaggaaaaaactaaaggctgataaccaatatgcctgaattttagctctgccatctccatccccaacaagaggggcattgcttttgttttgcgtattgagtttcaatataacactttagttgaaaagaaggttcttcagcaaaatacttgcaaacagaatccagcagcacatcaaaaagttaatccagtgtgatcaagttggcttcgtccctgggatgcaaggttggttcaacatacacaaattaataaatgtgattcatcacataaatcgaactaaaaacaaaaaccacatgattatctcaatacatgcaaaaaggctttcgataaaattcaacaccccttcatgttaaatactcccagtaagctgggtattgagggaacatacttcaaaacaacaagagccatctatatcaagcccacagccaacattatactgaataggcaaaaactggtaatattttccttgaaaatcagcacaagacaactgccacttctatccaacacagtattggaagtcctaaccaaaacaatcaggcaggagaaagaaataaagggcatccaaataggaagagaggaagtgaactatctctgtttgcagacgacatgattctatatctagaaaaccttatcaactcatcctaaaagctcttccagctgataaacaacttcagcaaagttgcggagtacaaaatcaatgtaaaaaaattactagcattccttacaccagcaacagccaaactgagagcgaaagatagaaaggcaatcccattcacagttgccacaaaaagaataaaatacctaggaatacagctaaccagagaggtgaaagatctctacaaggagaattacaaaacactcctcaaagaaatcagagaagacacaaacaaatggaaaaacactctatgcacatggacaggaagaatcagtatcattaaaatggctatactgcccaaagcaatttatagattcagtgctattcctatcagactaccaatgacattcttcagagaactagaaaaaaaaagactattttaaaatttatatggaaccaaaaaagagcctcaatagccaaggcaatcctaagcaaaagaacaaagctggaggcatctttaccagacttcagactatactacaaggctacagtaatgaaaacagcgtggtagtggtacaaaaattggcacataccagtggaacagagtagagagcccagaaagaagtctgcacatctacgaccacttgatctttaacaaaactgatgaaaacaagcaatggcaaaaagacttcctattcaataaatggtgctgggataactggctaggcatatgcagaagattctttacaccatatacaaaagtcaattcaagttggattaaagacttaaatataaaacccaaaaccctggaagacaaactaggcaatacctcgtgcacataggagcaagcaaagatttcatgacaaagacaacaaaagcaattgcaacaaaagcaaaaattgacaagtgggatttaattaaacttaagagcttctgcacagcaaaagaaatgatcaacagagtaaacaacaacctgcagaatgggagagaatatttgcaaactatgcatctgacaaagttctaatacccagcatttataaggaacttaaataaatttacaagataaaaacaaaaaccccattaaaaagtgcgcaaaggacatgaacagatacttctccaaagaagacatacatgtggccaacaagcatatgaaaaaaagcccaatatcactgaccattagagaaatgcaaatcaaaaccacaatgagataccatctcatgccagtcagagtggctattactaaaaagtaaaaaaataatagatgctggcgaggttgtggagaaaagggaacacttatacactgttggtggtagtgtaaattcgttcaaccattgtggaaagcaatatggtgatttctcaaggagctaaaagcagaactaccattcaacccagcaatcccattactgggtatatacccagaggaatataaatcattttaccataaagatgcatgcacgtaaatgttcattgcagcagtgttcacaatggcaaagacatggaatcaacctaactgtccatcaatgacagattggataaagaaaatgtgttacatagacaccatggaatactatgcagtcataaaaaatagtgagatcatgtcttctgtggctacatggatggagatggaggctgttatccttaccaaattaacacaggaacagaaaacccaatactgcatgttctcacttaaaagtgggagctaaatgataaaacttatgaacacaaagaaggaaacaacagaccctggggtctacttgagggaggaggttgggaggaggaggaagagcagaaaagatagctattgggtactgggtttaatacatgggtgatgaaataatctgtacaacaaccccccctacacgtgtttacctatgtaataaaccttcacatgtaccccaaacctaaaatattttttttaaaggaaaggaggttctatacaaaaaaagaaaaaaaaaaactttagaactctctggcaatacatgttatgcatcctgtgttagtccttgggtaccgtgaaatttccttcttttttttttagagcacctagtgccctccatcgtcatcaaccacccactgctgcggatgctgagcccccatctgttgagtgcttaccctgtgccagaaactctgtattgcctgtgcattttctcactgatcacttagactaggcttgggcaaacttttttctgcaaagggtcaggtaataaatattttaggcttttggaaccataaggtctctgtcacaattactcatctctgctgaggaggggaaaatggttccataagacaatgtgtattgtgttgaaataaaattcacacactacacggtaaaggaattagaactagaatcctggtcgttcaacttgaaattttacaatcttttcataattcctgctaatagtgtgacctcctaaactgtaaaggaaattttgtaggttaaaaaaaagatgtatttatcttctgtaagtggatagcaggacctttaggaaaagaataaaagtaatagaagaccaaagaggaagagactcttgggaagaattttttatttcacagaaatctttctcccccaatagaacaatgaattgcttgtcctaatattgtttccttacctcttaacatattgccatataacatattctgctaacagtataaagacttggctgtctttactttgctattattctttctgaatctacaaaatttttctttaaaaataatctgcatgtgttctccttcatttatttccacacttttccttcggaagacttgctagtcattggagaaaatatggtgtaatggttaagggcccaagagcgcaaatgagatttcctagtttttttatccccaactctattaatctttatcaaataacttctctgtgcctagatttctcaactgtagagtgtgtataataatagcatctatgacctagggttgctgtgaaggttatgattactgcatgagaacacacattgtgtacatgctggttactctccagcttgctcagtacatgtgattctttaccactcttgtttttagtacaagtcagtccttgagtcaccctgaaatttgccagtcacatttatttacttgatttatatttttcactcagatctgaatgctttaggaatatacccataaagagaaaaacttaaaatatattttacatttacatttttatgcaaatatgcatagattattttgattttaattgctctttattaaaagaagagtgccttttaaaaattaagtttactataaggtaaaatcctcattcaaggtgaaagcatttgtatttgaggatctgaagaagaatacatttaggtgatgttatctaagtgcaatgtatttttgttacttgtaaaagaacagtaaataacagacatatgtatagtcattagttatcatgattgtgattgatcttttaccctagataccaagtatataaagtcagttgctttgctgtctttggaattataataggtttgggtgaatgttctgtgattgctgataattatcgtattggtgggaatgtaccatctttgaccacatcgtctgtcaaaatttcagtatgtctaccagtctcccttcacctctcactcgtccaagaagcattcccaaggtaaagcagtcttattaaaatggaaggatgtccctagtgtgttgcgtagaaaacaacaaccatgatgagtgcagggatactctggttaggtaaattttctcgtgtttacatggatcttaaatgttaaccttgcctgcagcataattccaataagacaagaaaaaggtaagtaaactatattgaaaaaagtgactcttgttttccaagctaaattctgcctctggcaagacaagtcaattatttttctagtcaatgaagatagaaaaagaataaagtaaccagttgatttctgcttctgattagaaaattttgttttaatctcagccagagatgtttcagctttgccgcagggcaattttaaatacagttgtcaagggaggacttcttgagaaaatgacactagaacaaattcttgaagggagagagccatgtgaatatagggcaaagagcattccaggcagagggaccagccagtgcaaggaccatgaggtgggaacatgcctggaacatttgaggaacacgaaggaggccagtttgattggtgcacagtgagcagaggaaagcaatagggaatggagtcagagaggtagtagggaagggtagagggacatcatgagagctttctaggactttgtaggaaatggtgcctttttattaatttctctgtttagaactttgtatttagaaaatagtgcatttttataaaggaaattacttttataattaatacttcctttatgagagaaatcattacattattttaatttttaggaaaattcacaaatacatatataatcattttaatttcccatctctgatgaaaatttttgcctataatttcagtaataaagtatcctttgtaaaaattgttttctatatttgaccatcataccattttttaatatgctatattcagtttgaatgccgaacctccaatggttagctcattgttttctatatttttatttgacagaaagtagttcaaaagcaaatgaactactttgtggagattaaaaatatagtgagcaattttatgtcctttcaaaaagcatagtttgaaccaagaaaaagttactttttgttcctgctctttgatttcattttaattttaaaactaatttcatgcttttaaatgttaaattactataagggttttcaactttctgtccttaattctagcattatctattatctaccatgctaatttcctttctgattaattgggagtacgacagacaccagcacaaaaatagcagaggtcaaaatacttaacaaatgagatactgatacaatgcataattcatgaaatatattcactcctgtttttgatcttcctcaattgtaatgcgtcttgctaaatgcagctcaccacattgttttaaatgttgctgaaattttcagattcctaatgtttttatacttgtgaaaaaaaatctcttttggtctgttttgtcattggctttctttataaaagtttcttcttaaaggaatactcatttggctttgtacttcaaagttctctaatatttggttactcatgccagaggaattgtgagtaccagctcataattcaagttaatctatcgataagcaaagtataaatttacttcaccatataatgtaccagcattctattgttttgtgttttcaaagaaaagaacataatttattgttgtccttgcattagtcatcaggactattgcagctgcaagtagcagaaatccaattcaaattattgtattttaaaaaggatgaggggaaactaaaggatgtgggtttgattccaacccagtggctttaggtattcaaatgatatcactaggatgctgactgtctgtgcatttctctcacttcactaactcctgagtttagcatcattttcaggcaccacatggcagcaaattggcccctgtcagtctcaggcttatgcggctcatagctaacaatccagtgtttattatttggccacaagggctatatttggccattcttagccatgagaacacccctggataagtctttgtccagaagaatgggaaactgatatggattaagtgctcaactgagataggaaaggtgaaatggcaggaacagagaatgggagactttaaaaccagagatgcaagatgaacagcagcaataccaaattccagtgtgggttagtttcatttgtttcacaataaagggaaagattatgatgacatttttatcatttgtttgtttttatccctgtccagtaaaatcctcttttagattttaaaatatcctacattaaaagttaaaaataaatttaataagcaaaggcggtcctgctgtattctgggaagtgtctgtaaggctaccgtgctggaagctggttgtttggggtatgtgaaacttcaatgtcagtctgcctgctttctgagattcagatattgagatggtgacaattttgtttcagagcaaagaataaagaataaaaggcaagaaagtaataagaaaaaagaaaacccttgagcaggaatagtaacataacaagatcaccaccatcctttcagaccaacacatttaatgagtctcagagatacatcaagagcatatttcttattccagagtcaatagttagcaactgaaataacctagtggcattaatgctcctgcagggccatttccctttttcatttctgctgtcagaattttcgacctcatcatccctagcctggattaccactttggccctctgcttatcacacctgctttgagggggtcaggagctcaacttggggtcaggctcaccatcatttttttctgagttggagtctctgttgcccaggctggagtgcagtggtgcgatctctgctcaccgcatcctctgcctcctgggttcaagcgattgtcctgcctcagcctcccgagtagctgggattataagtgtgtaccaccacgcctggctaagttttgtatttttagtaaagacggggtttcaccatgttagccaggctgatcttaaactcctgacctcaggtgatccgcccacctcgccctcccaaagtgctgagattacagtcatgagccactgtgcctggccacaccattttgaaatacaaggttaatcatgctgctcatctgtgtaatactcattgacactttttttttttttttgagacggagtctgtctctgtcgcccgggctggagtgcagtggtgtgatctcagctcactgcaagctccgcttcccgggttcacgccattctcctgcctcagcctcccgagtagctgggactacagacgccctccaccacgcctggctaattttttgtatttttagtaaagacggggtttcaccgtgttagcccggatggtctcgatctcctgacctagtgatccgcctgcctcggcctcccaaagtgctgggatcacaggcgtgagccaccgcgcccagccatcagtgacactttcttaactacagatgcacgttttggagcacaggaccttttatgatacatgcctaggctctggcgagtgggaacagcagtcacatgacagtctcacatccccctacctatgagcaggttgcataggtgtcagtgagcgggttgcatgggtgtgagtgtgtatccagtgtacttttctgggtcttagtttcatcacctataatggggaatcaaaatagtgtctgccttgtagacttgtgttgtgagaactcaattcaaaaaaaaaaaaagtgacatattcaccacagcatttggcaaatactaaactttaaatgaatgttggctattctctgacccctctctgtctgtagccctatccatggacactctcccaaatttgtcctatgatttagccacagcaaccttctgagttcctcatttgccactctgtttcacacttcttagccttcattcatactgccccttctatttcttccactagactgaacagtataaagttagtaattctctcttccgtgcttttatatacttaacacaatgccaggcactttgctgaagactgtaacaaatactgctggatgaggacaactatttctttctcaaaattgaattgacttctttgtgtacttgccttagttcagcttcatggtggggtagtgcagaagcctcattgaaggaaactattttgccctagtgtcagggatattctgcaacactgcagaatgggttttgtgggctaagtgtagtgattttactgacagccttttaaaattttctatgctgtcccagagacttcatgaaaaaaaagttgtatgatcggcctgtttcaaataaagctaacattagatcatttaaaaaagaaatcatgtttatttctagggttattagagaaaatataaaaattgtcttgaaattgtagaagcttctctggagctgttttggggagttttggatggggtttattactgctggatgttaagaacttcttctagattatgacttgtcttcttaagactccaccttccctgtgccggagaaaacaaacatgacccctgcaagtgcaggtcactaatattgagggtattgggctctgccatcaaagtgtgaagaactactggccctttcattttcatcagcattgaaccattcaaccagggtgatttgtccgcagtaaaatacattagaagcatttctcctactcaaatgtgtagttgttaattggcaacttcttctgagaactcaaaaatattcattcttccctgatttccatagccagtcttgataaaagtgaccccccaaaaatggtagttaaaaggagaaaagtatgaagtgctaagagaaataaagttttattataaatatctttcatattagaattactttatttgcaattgcagtgatttatttttggtgagttgcccagaattgcttcaatacagtaaatgactgtcttgttcaagacatgcttcttacttgtttgtgtatgaacacaaaactatttgccctactttataaatatttaggttcattttatcattagtccccaagtaaacaaacatctcatccagtgacaaaaaagcaatgtattctaattgtctaatataacaaaacatttttaaattaactttatgcaaatttgataggatatttttcattagttgattaaaatgaaatgtttgaaaagttgcttcaaatatttttcacaattaaaattattgttgccatagattaatttgtcattgaaacacttacaaaaatacaagttaatttctttgcaaactcattgcaattgcacttagagatgtcttagaaataaattataaaatattttttaaagatttatattagctttataataaaatataataaatgatggctttgaaattatttgtattgaactacaaaaggaaatgtcgtaaatcccattctgaaaaactttttattctttgtaatggtaaagggaagcattacatagaatatctttaagataattcttttgaggccaggtgcggtggctcacacctgtaatcccagccctttgggaggccaacgtgggcggatcatatcaggccaggagttctgtaccagcttggccaacatgatgaaaccccatctctactaaaaatacaaaaaattaaattggcatggtggcatgcacctgtaatcccagtatgcaggaggctgaggcgtgagaatgatgaacccaggaggcagaggttgtagtgagacaagaacgcaccactgcactccagcctgggtgacagcgagactctgtctcaaaaaaaaaaatgataattcttttggcattctttgttatatttatttcttagaaagaacatagtgtgtgtgtgtgtgtgtgtgtgtgtgtgtgtgtgtgtgtgtgtgaatgcccttcttcctccccatcctcagcatactagtttcttattttcataaaataagtgataaatttttttggatttgagaatttattaaatcaagtcacgtattaaggaattgggaagcaaatatgagagagggtcaatgaaaaatttaggatgctcacatggtaaatcatgagctttaaaatcagagctgtacataagaagctgtgttttaataatctgcctttgccatgtttcttcttccagttgaatcttccagttggatatccactatcttaaatgttatgaacacttaggatcttgttatgtatatttaagaaacttaaaatgcttattacaaattattaatgcttaggaatttgatttttgccaatgcccaagtaacttattggttggaaactgcatacatttgatagaacaagggctgattataggtgaaactaagaaagataaagctaggttttggagacttgcaccttatatcggagacccagtcctaccatgtgtgtctgagagtttgcatttcctttggctatacattaattcttttaaaaaatttgaaatataatatacatatcataaaattcacccttataaagtgatttctttatacaactttatacaacttagtgatttctagtgtattcaaaaagctctgtaaccatcaccactatctaattccagaatatttccatcaccttaaaaagaaactgtacccattaatagtcatttcttacttccttcttttctagcccctggacaccatattctactttctgtctctatggatttgcttatcctatctctatggatttgtcctataatggacatttcatataattgaaatcatacaatctgtgcccttttttgtctgacttctttagctttacataatgttctcaaggttcattcatgtagtaacatatatcatttattcattctgctttatgattgaataatattccattgtgtgcatatactatattttgtttatccatttatcaattgataaactagaataattccactttttggctattgcgaataacacttctatcaacattcatgtataagttttgtgtgaacatatatttttaatactcttgtatggatacctaggaatgggattactggatcatatgataactctacctttgagtttttgaggaactgccaaactttttcacagcagctatgaaccattttacattctcagcaatatatggagattcaagtttcttaaccttctagtcaacattttaatttgcagttgcctaattttgagttatttatctttttattgctgagttgtaataatttttcatatattgtagatattagatccttatcagagatatactttggaaatattttctcctattatgtgggttgcatttttactttctttatagtatcctgtaacatgtacaagtttttagttttgaactccaacttacctttttctgtttttggttggctgtgctttagctgtcttatcaaaaaatatttctctaatccaatgtcatggaaaattatacctatgttttcttctaagattgtcgtagttttaattcttacacttatatttgtgatctattattaaattaatatttgtatatggtgaagtagaggtccaatccacttctttttgcatgtagataatgattgtttcagcatttgttgaaataactgttctttttggcactcttgttgaaattcaattgaccatggatatatgagtttgtttctggactctccattatagattactgacctttatgcttatcctatgccaataccacactgtttttattattgtaactttgtagtaaattttgaaatcagtaagattaagtcctaccaacttttgttctttttcaggattgttttggctttgctgggtcccttggattttcatacgatcttatagataaacttgtctatttctgtaaaaaagataaaaggcagttgaaatttgtggaggaattgtatttaacctgtagattaatttgagaggattaccatcttcacaacattaattcttcgaaaccatgaacataaacatgtctgtacttgcttaggtcttaatttctttcaacaatgttttatagttttcagtgtacaaatcttgctttttttgttaaatgtgttcctaaatacttttttatacttgattgctattttaaatgaagttttttttaaatttaatttacagtttgttcattggtagtgtatggaaatacaactgaactttgtgaattgatcttgtgtcctccagctttgctgaactcattactaactctaatagttatttctttgtgtgtggaatccttaggatatctgcaagtatttttactttttcctctgtactcttgatgccttttatttcatttttgcttacttcctctgactagagcctccagaatagaagtggttaaaatggccatcctttctcgttcctgatcttaggggaaagcttttagtcttttaccattaagtatgatgttagctgtgaaatttggataccatttaaattaagttcacttaacttgaattagattgttataaatttagatgttgattgtagtccctggggcaaccactaacaaaataactcatcaactcatctaaactacactccaaaaccttgggaatttattgcatgcttccccttctcctgccattcttgatttcagctattttcatttttgctgggcctattgcagaaactttaaaactatttcctgatattccattctttctgtcctccagcttatcctccatactgaaagcagaaaaatgcatatttgatcgtatcatctcacaccatcctactactgctaataaatccttcagtggttcggcattgacttcaataacagatgcaaactccttggctgccatctcagcacctttcttgaaacatcctattacctcccctgcttcttctgatggtctacccttcacatcagacacatacattgacacacacacacacaaatgcacacacacacatccttactcctttaaccatccttgtcctaatcacttcacaaacatgccattctctctctctctctgtcctttccatgtgttgtttcgtctgctgaaacacttttattttctccctcatctatggtgcctcaaattttcaaactctcacattaccttctttaggaagcttgcctagcttccctttttctgtttgatggctttctatcctccactttcctcttctaaccctcaagtataaaattacactttattttaattgttgatttacgggtctgccactcaccttgcccgctgagtttcttgacatcaaattctatttttggtttctggatatctcaagctgaacagtgatatggagtaaatgctcaaaaatatttgaatgaatgcttactactaatagtgtactcatactgcccttctgggtatccagaattaaatactgagttttactcagacatttctccatggaaggacatggcatcttgaatctttccttcttttatccctctttcagcccattctatctgcttggttataattactacagtacactcttcactgaagaaaaaataaaaaaaattttgatttgaactaagtgatttcccgattatttgattcctaatctaagttataattctctgggtcaatagttaaaactatgctcagggttttgtttttatttttttcttataaaagagtgattttttaattcagataatatagacacatgagatataaattaaaaggctgattttaaggccaggtgcggtggctcatgcctgtaatcccagcactttgggaagccgaggcaggtggatcacctgagatcaggagtttgaaaccagcctggccaacatggcaaaacactgtctctaccaaaaatacaaaaattagccaggtgtggtggtggttgcccataagcccagctacttgggaggctgaggcaggagaatcacctgaaccccggaggcagaggttgcggtgagccaagatcatgccactgcactccagtctgagcgacagagtgagactgtttcttcataataataataatagaaataaaaaggctaattttaatgttaatctcattttcctgaggcccactggaaagaatgcagtggtggcagggctagccaaaatgagataaaaggatcacagtttctccaggtaaggcaaagtatacgttgtcagtgcagaacaggagtagccattgtctggcaccccagtggatccccaaggacacagactttcattgtgtggtttagggaaaggcagaaattatattgtagagattcagcaattccaatgacagattcagagacttgattgtgttccatcagggtaccctggatgatagtcttatgaatcactccctattgaagcagtagatctgactctagtcattaagggattcatttgcttttgcataacaaacccaccaatccctttgtaacatattgctacctcactttcacatttcaaatatagacttgtgcctacattcaaactgatgaattggaatcaaattatgttacccgtctttaactaacatcaggtggagtgtcttgccccctctacccactaaatcttttattactttggggaagggacactggcaagccccagatattgacttcagctttctcttctgaagatatttcatttttggtgaactcttaaagccatcttagattaataccaaataggagaattttgggccctgtggcaggttgacaaaacttcctggtacttcatgtcataaacactggatcataatggctctttaataacctgaaaatgttgacataaacccatggcttatggcattacctagagtcatttagatactgagctaattcaaaatttgttaggcaaatgtgtataccattatgataggatatttaagcccttagtaaataaaactgtacttatattttgcaaatataaatgtaacatcaagcagctatgcttagtcagttttctaattgggaaatatccgtgaattataaagcatgacttaaaatatttaatttgtaattagcgtagaattacaaagataattcataaactcactgtttacagatgagattttaattgtgctttttaaggcttaaatatctctatcatatggcatatttaatgagtcagaacaatttggaagtaattattattatgaaaaaataattctgtggcctagataggtactgcagatgatatgggcttactgactaaaattaaaaattggaagtaagagcttatagaaaatgtgacactagcataaactaagaaatatagagagaaggaaggaaagcctgtaaatgcttgacattttatgagatatttcatttactgtgtcacattagactgatgatctaattcaacttccttgtttcacgaatagagaataaacttgagattcttcaaatggccagacgaggatcacacaacttactgacaccatcctggggtagaacccaagtttctaagccatcaattttatgttgtccccataggaaactctcattatgaaacaacttctcagatgcctattgatctgggtttaaaaaatacttaaacattgtcagaatgtgttatatgtagtcttaagtatctcagagtttcaaacataaatgttcttgaggtcatatcttttccttcatgatatgaagaaaaaaataaaatatttttcctaacaaagaaagtggaagtataaagtctattggaaatcacctttctcttatgttgatgtataaacagaattccatatcttgtctggttataagcactatcaggacaatttttatttcaatagttaaaattgtacataataaagaattataatagctacttaaaacactaaaagttaatgtggctttttataggtttaggagaacaaatactgaactcttttgtgggaaaactcagagcattcattgttccggttatatctgaagttatttacaagtataattcatgaacttctattttatctgttaaacaaaattataggaggccattgttttggactgagctcctgttctgggccccaacaaaccagaccaaaccaaaatggagtcactcatgctaaatgccaaataatcaaacggaaactttaaaggagcatatgcagtcccaagcagaccagtttttcctcaaaataggagattctattctatccgaatcagattaataaggaagtccagtctgctttgccccttacaaaaaaaagtaatctagggctgggcgtggtggcttatacctgtaatcccagcactttgggaggccggggtgggcggatcacctgaggtcagaggtgatcaacatggtgaaacctagtctctactaaaaatacaaaaattagctgggtgtggtggcccacacctgtaatcccagctacttgggaggctgaggcaggagaatcacttcaacctgggaggtggaggttgcagtgagccaagatcacaccactgcactctaccctgggggacagagtgagactctgtctcagaaaaaaaaaaaaaaaagcaacccagtgttaaccaatccattttttccttattcccactttttaaaaaaaccactgttctgctatagcccagtgggagctctcattcttttttataaaacggaggctacttgattcatgtgtctcaaataaaagccaattatatctatcactaaatttgttgtaattttatcttttgacatatcctaagccatccatgctttataacttgtaattctctaaaacatattttgtgattcttggtatttataccaagaatttctctctctctctgtaactctctcactcacccactctctctctctttaatttaccctctggtccctatctgattatttggcaaataggactgcgaatactccctctgtctcttcaagctgctctcatcaaaagaaggaatttacacatattacataatggacagaaatgtttttgccccaattttctcttagtttaaaggtgcttcttttcttaaagggaaatttgcatttttcatttcatgtttccctttaagaacatacttacatacttttgtgtccacattgataaatttatttgaaatactgctctttggggatcattccctaattgcatgtattcagctataaatattgataaatataacaaaattggctgggcgtggtggctcacgcctgtaatcccagcactttgggaggctgaggagggcagatcacaaggtcaggagatagagaccatcctggctaacacggtgaaaccctgtctctactaaaaatacaaaaaatcagccgggcgtggtggcgagcacctgtagtcccagctactggggaggctgaggcaggagaatggtgtgaacctggcaggcggagcttgcagtgagctgagatcaagccactacactccagcctgggaacagagcgagactccatccaaaaaaaaaaaaaaaaaaaaaaaaaaaatatatatatatatatatatatatatatatatatataaaacgaaatcacagataaaatagatactcaataatcattatagagactagcatgcactgctatttagatatacatatttaataagtcatactggctctttagctgtacctaaaacatgccaaatccatttttgtgtcagggcctttattcattattctttcttcctttgataaaaaaaaatacttctttctatgctaaatgggatattttgtagatcataaattcgttagtaaaactctgaagaaggtactactgctttctccattttacagatataaaactaaggcagagacgtttagcttttgaaggattaaatgagataaagtacttagaacaaagtttaaaatgtagtaagcaatataaatattactgtatataaatgtgaatcaataaatattagcttttatgatctgatatgtaaattttttgcatttctgtaattcttttcccaaagtcactttacaaaacacaattttcttagctgatgaaagaatttttataagcttccagcctaaagctcttctgtaggcaagctgtaaaaccatcattcagaagttttaactgtttaccctgaatccttttaaccataactccggtttttgtactatagtgattagcagcagtcaactgataggatgtgattggaacagttgtgagggaaaagaaaaaaaaaaaaaaaccttctgacttgaatggatcataataatgacctgccaccctaagtcaccaggaagcacttaaattatctttattttagtccattaaaaaagcaaaggtatatgtaattatatgctttagaagttctacctgagctgctgaataccctgtcatgttttcaatacaacttttaaaatccataaatacttcagaagaaagtttaaattgtcccctttcatgttttctgcctaagtataattttcctagataggcctttcctgatcaccacatctaaaatagatgtaaccctgtaacccactagccccttacatacttgctgtatttttcttcatagcatttatgatttcttaatattatatatccctgttatttagttgttattgtctttttcctcccctaggatataaatcagaacagctttttgtgacaattgcggtgaaacagcttttcctggttttgtgctatattcatggcacttagaacagtgcctctcatatatagacattcaaatatgtgttgaatgaatgaatgaataaggaatagaaaaccaccaaggaacacagcaggaagcaatgatttacatttatactatctactataattttaggaatctcaaacaatttttcttaaagcctctgtattattcaacatttactgatatttgcaaaaagtttatagcaaatcttagtgtaatctcaaagatacattgggtaaacttgcattattcataatgtagactaggcaaatataaacacagtacatgaagatactaagtgataagcccaagcttgaacagcttgtctgccttaaaagcagtcaacatatttcaactgctgctactaaaagtttcgttttatttattatataaaaaagtgaagacgtcccaatattttttctctgtcacctctgtatatatagtttattttatagccttcaccttacttaattttatatcttgggactaaggctactattttccaaataaacgtgctcatatatctaaaacaacagtaaatgctacgtataaatatgatatacaaattcaggttaatgagacttgaataagattgagaaaaaaggaaaatatttaaaatagtacatctttttagaaatacttacatattgatttcctcatttattcaattagtcaatctacatatatatatatatatactttctaacaaacagtattattaaaagacaactaaatgtgatagaatatatgttaatgaaacaaagataaataatattgtctcatctctagagggacttcagtgggggaagacaggaatatcaaatatgtgtgaatgtgtctgcacacacacatacaccatatatatatttagtgttctgtcctgttcaccatctgctactgcttcccacacaagttcttctgtcctctgaaagctctattcttctatccacctgactgctaaccaaatgatctcacctctaagggaactggaggccatacatttgcttagtcataagtaccactgtttcccattttcccatttctgtatttaaaaagtgtttctctatctgcatccaagatcacctcattttgtcaagcctcagaggaggttttctcctctttttctggactaggatcatccttccatctatatcccccacctctattttttttttttctttttaggtaaaagggtcttgctctgttaccaggctggagtttagtggctccattatagctcattgcatccttgaactcctgggctcaagcaatcttcctgcctcagcctccagagtaactgggattacagatgcataccaccatgcccagctgattaaaaaaaaaaattcttttttttttgttgtagagatggtgtctcactatgttgctcagcctggtctcaaactcttagcttcatgagatcccacagtgctgggattataggtgtgagccactgaacctgaccccgtctatatccttaatctgatgtcttctcttcaggaattttcttgcttctttttcttttcttttcttttcttttttctttttttttttttctcgagacagagtctcactctgttgcccaggctggagtgcagtggcacgatctcagctcactgcaacctcggcctcccaggttcaagcaattatcctgcctcagcctcctgagtagctgggattacaggtgcccaccaccatgcctggctaatttttttttgtaattttagtagagatggggtttcgccattttggccaggctggttttgaactcctgacttcaagtgatccacctgcctcggcctcccaaagtgctaggattataggcatgagccaccgtgcccggcctctcttttcatcttttatgtatttttttagcttttctctctctactggctctttcccataccctgtatttcacctctgggttgttttttcatagttcatctgtgtgcagcccataccagtttgcatctgagagtccattgtgagcatctcttcccaacattgcatttggtgtcacactggtagattgaaattgccctcactatagtggggttatttttgtgtgggaaattggcaaattctatgaatcaaattcccctccactctccagcaccggttgttaaacatttacaggcaaactgctgctgtagtccctcaccttcccttaaaaccatgttctggaaaagagtatactctaaatctatcagcttcttcacttcacatcaaatctctgaaactagacagcttcccttgcctctactggaagtcctataccctgggagtcatcttagactccttgcttttcttcactctgcaaatccagtcagtccctgactatctttctgtccctcctcctccatcactccattctcactcccagctaccttctttcaggtctttaccatttcttacatagattgttataatcttctcccagtttgtcctcctgccttctgtcagactcagcccattcttcccaatgccactggaatggtgtgttttaaacatttaaacctgatcaagtttcttccctactcaaaatccttccctggctcttcacagcctctgggataatgtctttattatataatactttgtcatttccaaatagcagaggaccatgtccagatcgcttaagcaaaatggaactaatggcaactgaatattctagagaatggatctaggttgaatgatgtcaacgggaatttgtttctcttcatatttcagttctgctttccattgtgttggtttcagtctcaggttcggtgtgatagcaaggatggtggctgccactgcagctgtataatgtctcaactttaacatatagcaagaaagaaactagaaactccaaccttcccatgaagagattcataattatctcattgcaactgggccatgtgcctaccccaaaggaatcaccattgctagtaaattgtaatatgttgattggcctgtatccaagccacatgaaagttaaggaaggtgtatcctcaaatggaaattcaaactcttgctggaagaatggacagtaggaaagcgactacttataatgaaagcatctaatatgtatttagcgctttgtatatctcgggtagtgcttcagtgttttgcatgtgttaacttaatttttaaaacaacatcatgaggaagggagaaaactgatatacagaaggcttaggtagtttaactaagttagacacagcaaattactggtgtttattgcaaaatacaaatttctgagtatgggccttcctttactttcttacctaataaattcctgagaatatttgtaagccagatgactggtagttcagaaactaacttaaataatataaagtgaatgtgttacatttttaaagagctaaaaaccactggagatttctcacattccctgtcttccacagcaccagatgacttttagagtgcatagaaatgtcaaaatgggtggggttccctggttttaggaggttaatagctcaggattgggttggggtggagatgttaagtccccagctgcttgcagcagatatctgcttcccacgaactacagtttctctcctaatccctccacagggatcagggtacaaagatagctagccaccgttttttgtttttgtttttgttttgttttgttttgttttttgagacggtgtctcgctctgtcactcaagctggagagcagtggcacaatctcggctcactgcaacctccgcctcccatgttcaagcgattctcctgtctcagcctcctaagtagctgggactacaggcgcgtgccaccatgcctggctaattttttgtatttttagtagagatggggtttcaccattttagccaggatggtcttgatctcctgacctcatgatccatccgcctcggcctcccaaagtggtgggattacaggcatgagccactgcgcccggccaatttttttaaacttctacttgagtgaaaaggcaattacataggattccggcctttctcccagtagaagcagtggacaggaagaatttagccagctgatgcatgaaaagtgaaattttgtatattatgtgtaacactcttgtattcctttccagtcttacatcttaccacatacccctcacattcatcctttattgtaaaatcccgtatgcctttctcttacatgcctttcacaattcttttgtgtcttgacaaattctacaccatctgcatctgacacatcatctctcaaaagttgtgtcaagtgtcgtcttcttagtgaacaccttcctggaatcaccctccttgtgaggaaacagctgtgcttccttttgtccaattgcacttaaaagaacatttgccatagtttctgtaactaattactgtgtttctgtatttatgtttgtctgcttctcttatgctgcaagatccttgaaagcagggagcctattttattatttcttatatccttagaaaagtgcctgacacacagcaggtgctcaataaatgttagagaaattaatgaatgacataagaacacatagcaggtgctcaataaatattagataagtgaatgaataacataagagatatgcagaaaatataacaaggactcctaattggcaggaattaaagctggttagagctaggagggatgtgttgggcaaagcttctcactctaagattctagatttgagaccattaaacacatatattcctgcaataaagatagcctttgctatccaaatatttactgtcacattttgctagaattttcacaaaagttttagtatccaaatagaaaattctatcataacatttatataagtgcaagaatggaaatgtttaagtcgtaggtgagtccatgtaggaggatatagagtatctccatatagaatcatgccagtgtcttctaaggaagtagaaaagcctgtgaagaaagttggtgagtacaagaggtctagaaaatcccatgtattaaaagaaatattggtgcataaaatatacagagaaagattaacacataaaacatacgtttgatcatgcacatggctctctctataatgcttgtattttccacatgtaagacaattttaaaatatattatgattattggttttttgaaagcttccctgtgtcactcaagcataatatggtatgtttgagaagctagagacctatctcatgtggtgggtagacaatcagaaaaattgaaaccatggattacctactgatggcgctgtaattctttgaagatctgaaggagatgaaaaaatttgatcattcggtaaaaagttgactttcagctgaaattctggactagtacaaaagattttaaaactatgtaagatagatggaatcattggaatgaagatcatagaggagggaacatcttggtaatggggttgcagcagtttattccaccccccctaccgccgccagtgaattgaagaaaactatcgacaaaggtagcaaacaaattttcagtaatataaattttcttgatataatttggctttttataaataagtgttatcagaagataatgaaaaagagctagaatattacgcatccaaagataggttagcataacttttaagtgaaaattgtggaggcgatagtaaactaaaacctctctacttgtgtaaatctgaacagccgggactattaaagaaatgtggaagggtaaagtgtctattatgtggttcttaaatctaaaacttggttgaaaaaggaagcattcagtcatttttcaaggagtcattgtttccagtggtccattttttaggggtatagaatcttagaacataaagaattgtggctgaggtttgggtaaatttcatttaataaaataaatggttaataaagttgctgtgaagaaacctagtttggatgataaactaagaaaatttctttttttttttcacatcagcatgaatatctgaattatttttccatccctaattcattttgccagtggcaacatcatttctccaaggatgctgtggcttcactgaatcttcagtggtactctctgaggtttagaggccctttctgttgagttccaaaaaatggaagctctggctgggcgcggtggctcacgcttgtaatcccagcactttgggaggccaaggcgggcggatcacggggtcaagagatagagaccatcttggctaacacggtgaaaccccgtctctactaaaaatacaaaaacaaaattagccgggcgtggtggcgggcacctgtagtcccagctactcgggaggctgaggcaggagaatggcgtgaacccaggaggtggagcttgcagtgagccgagatcgcgccattgcactccagcttaggcgacaaagcgagactccgtctcaaagaaaagaaaaacaaaaaaggaagctctttggtgttcgattttaattaagcatgtccgtgtctgtggagtgaaagccaaaggcttttagagaataggcaattcttctctaggctcaatgaaaggacttgtttaagagaagccaattgatttttatcacgttgtatattttccaataatgccctaaagaagaaaacattttcctaagcaaagagtgacatgcagatttcttttgtgatccgtatttgtgaaaaatgcctcacttcaggattgcaatatgccctaacaaataatactgcctgtgcctgggggctgagtagtggttatcaccggagaaggtcttaccctcttagaagtagacattagttttctactatctattgtttgagtatgagtcaaacagtagatgcagatgccttcactgtctaacagaggaaatatcaataacttatataacctttataacatagcaattcaactaaaattgacttaacagatatttattgattgttgattgtaggcaataaactctactaggttgtacagggactaggaaaaaaattaagatataattattgttcttgaggaattagtaaaagccagatcaaataagtaaataagtagttattgggtttattttgcttttgtactttttctaaaatacctataaatgattaattatattttatgtgactattactatatctgctctttcattgactgtcatttgttatgacaaaagggggctctctgattcccatggctagaaacttcaaattcagtatttcttaaataataaatatttcttaagtaggtaaataatatcatattattaacatttagtgttcacctttcacagataggtaaaccgtaacatgagttttctgatgaaccttgttatagaaatatgtacaaaatgtataaaatgtgaagagtacatatatgaagggaactgaatttttccaagttttgaattaaagtgggtattgatttttgagctagattttgcaagactaatatttctattcaagaagggaaaggacattccttgaaatgggaacataatgatcagtttgttcattgtgaaacataaggtcatggatgcatttagtttatttggagagaaaccaggtacatgttgccaggtttagggggcacgaggggtgggaaagtttaggatgaatatcaacaaggtgacttgggctgtgctatgaaggacattgaagcaaagtctgaaaagtcttcagaaaacacacacaaacacacacgcacacacccctacctatttatatattgcattcctaagtgcattgtgttcaaaagctgattttcctcgacttgtcccacgttacttcggaacattaacatgcttatgttctgagaatacagaaagattcattaaatgtgcctaagatattttctcatttgaaacatttattttaaaaaatttaatctgctgcttttttttaacttaaactgttttttggcaatcttttttattgggcaatccacatgggtttgaacctttaatgactcattaaaattgattgtagattctaaaaacattataaaaacattgataaatatatcaaaacagctggttttgagatattgtacttttaaaaaatgattatttatttagtgctacccttgagtacaataaagtacacctgaaaaactttgagttttgaaccgagaattctgtttaattttgggctagttccaagtgaagagcactgtgctaggccttcagcagagagtggaaacaaacacactgagcagtagtaatccgagggaagacaagccagaagatatagcataggccacactgaggaggatcccaagcgtaatagttaggttgtaggaatagtcatcagaggttttctaaataagaaatttgcatatgtaagtgctttcccttaataaaattacattgtaatatggattggagggttagagacaagtttgaaggccaatgcaataatttccagctaatttccagccagtgatgtgcaaactgtgtaccaggaacaccagtgatcagtggagaggattcaagtatttgccaatgatatgttccccatcaaacactgaagattttttaattttaagaatttaaaaaaattagggtgattttttgattattaggtttttgatcatatgattttttgatcatccaaatgatcaaaatgatccaaatgttcaaaaaatcattatattatatgttccccattaaacactgaagattttaaactgcccaaagaatttaacttttttaaaaaattaggatgtttgtccatttttaagattttaatatgttattcagatgctttaaaaaatctgaaaaaaataaaccagtcaagacaaaagataataaggatttgaacttgggggatggcaatcagaataaagaggagaaagtgacttcaagatatgtagttgagcagtaaacaaagcaaaacagaaacgaaaacaacctcggactaccatttaataaaaaatcagggaaaattattctggaagccaaagaaaaagatcaactccatagattaaaattttgaaaattatctcctgagaaaatcacattagatagaactttgaacaatattaccatatggaaaaatggtgatggatccatgaagaacagtgaaaattggagagcttcgatgtttcagcaccctggaagtcaagggttacaagttacccaaagagagagggaaaggaaagggatgggtatagcaggcaaagggaataacacgtcaacatcctatgagctatagaggcacaggtgcactcaggaaaatgcaaaggagaaatcaggaacaagtgggcggagtggagtctgacagaagcctattggaatcagtagttaagtcaatacaccagttgactggtgatgagaatgttagagtgaagctcagaaaacaagagtggatgtaaaaaggtgaaggctgtgggtatagggtaatagttggtggcatttgtgaatacagggaagaagtgagagaaagcaatagtttgaagtcacagctgaggcaaggaaagattgtacagaatcagaaacagaggagaaagaaccagtaagaggcagacatgaaagacggaggcaccaaagaagcttacaatcgcattaaagttcaggagaaaatgagatcaacgcacagggacaaaagttgtctttatagttcatatatgaatgaaatgatcttttttctcagaaaattatagcagtatctgatatagttaattattctcgagaaaatatctcaaactgttttagggtgatctttgtttgaagtaataatttatttaaaagttgctgtaaggttcataactgtttagttctctggctatggtaaatacttcctgtaatttgaacataaggatatttctgaagggggtgcttaggctaatcacaaatatagacatgttgctgtgataaatgctttagactaattactgacatgctcaattgaatactaatacttcccatgaaatgactttaatacaagtaaaatgacagctgcactgcagtgagaggacacataaaactgcattagtttgtctccaaggttaccatctgtgctgatctgaagttttaatgtgtgggatttctcaacctgtgcaaagactgtattttcaggataggtatcaataggatataaaagcagcttggaagctacttaagcatttatttgggatacatccatgctgaccttaatcattcaattgttctagagagacacatatctgtgttctgttagaaattttgtgcaacgattggggaaatagaatgtcaggattatttgactccactttgcatatacaaataaaaagatgtgaatttacatgttgtacaactgaactacattctggataaaattgaggggcaaaacagatttgaaaaattggatgacttctactctagagttttcatagttattccataattaatattcaagtttcaagaaaatatttaaaaacttataaaagtatagacattttaggagtctagaacctataaatacggctccaaattaaagaaatggtattttgatagtctaaaaggaaaagagagactgctgttagttcaaaattgtatagaacttaacatttcttaatgtaaaacatttatcattttttcaacaaatgttgattgaataccttccctgtcctaggcaccgtgctaggccataagtttgcaaagtcattaaaacttgctgtctgtcctcaaggaatttacaatctagatggaaaacagaccagcccaggtaattaaaccaccctttctgaaggttgtcatggaataagaacaggatgttgtgaaagaacataggggctgcacataatgacgattaggcaagtttggaagaaatgatgtgcatgttgagatgtaatgagttagaagttagctgagcagaggggaaaggaaagggatgagtgtagcagacaaagagaaaatagcacatcaaaggcctgtaagctgtggagacacagatgcattcgggaaaatgcaaatcagcttagctgaaatatagtgtgtattggggagcaggggaaaggaggtaagggtctcagtgagagaaggtggaaaggaaagcaggtgtcagatcacctggagtcttgtgaaccatctcagggaactgatactttactgcgagggcaatatagagcaattacagagtgttggggaagacatctattaccaccagcatctccttgttcttcctcatgattgtcgtcatcatcattgtatgaactcactatgtggcaggcaatatcaagttagttcatgcatttttacataaaatttttatcatgagcttattactacatctaatattcctattttacaaatgaagaaataaacaaggaatgcacttagtttccccaagctcacagttaccaataagcacagttggtaatcgcatccaggagtttctgacaccatagtagtccctgcctctctactctgcagttcttatgtagaaaatgactgtgttccaccaagagcactcagtttgcagtgtattgcaatgatgtattagatgacagctaaactggaaaggggggctggttatgaagtcattgttattaatcaggcatcagaagacagtggatagaggtagtgagaatggagaaaagtggatgtgttccaaatatatctcagaggtagaatcaaccaggcttagtgattaactggatgggtggaacaatatacttctggcttggacgatgagtatatttcaggaagtgtatttgtaaaatccactggatatgttggttctccaagaagcagtaatgtcagaaagattacatttatacatttctggtaggaatgtaaattagtacaacttctatgaaagggagcttaccagtgtgttttagaatttaaaatgtgcataggattgacccagaaattttatgtgtaggtatttatccacaaatataaaccgatattatatcatgtgtataaggatatacactgcagcatcttatgtaattgcaaaatattgcatacaaactcaatctccttcagtatgagattggctgatgaattaaggtaaatccattcaatgaaatgctctaaaatcctgaataggaatgaggcatctctatatgtgtattgatggggaaatattgtatatgtacatgactttatgactgtatgtatgtaaaaaataaaggtgcaggtaaaactgtatatgttaggctgccattttatcaaagccaagtagatagatagatatcgaagtagatatagatataaatctgatagctgggtacagaggacagaaaagggagagatatttattcttcagcgaatatccttttgattttactctataagcatagatttcttattaagaattaataacaagataacacaaattataaaaattcaaggcagaaccccctcttttaaaatcttgtctctagagaaagtttaccttaagggaaaagtaaaactgttagtttggtttccttgtttattttgtgcctcattaagaatttaactatgggctaggcatggtggctcacgcctataatcccagcactatgggaggcagaggagggcagatcatctgacgtcagaaattcgagagaccagcctggccaacatgtcaaaaccccatctctgcaaaaaaatacaaacattagccaggtgtggtggcgcatgcctgtagtcccagctactggggaggtgaggcaggtgaatcgcttgaacccaggaggtggaggttgcagtgagtcgagatcacgccactgtactccagcctgggcgactccagcctgggtgacggagtgagactctgtctcaaaataataataataataataataataatttaactatatagacaatcaattttcacaggaaaaataatatctttccccaatgattgacttatatccttccaaagtcctggagttccaaaaattcataattcaagtgtaagaatataataatgtcactaaattattatttttgagtcattcaagtcatattgttgctaacattttattttgttcattttttacattaaatttttttcttattttttaattggcaaatataaattgtatctatttatgatatacaacatgatgttttgatgtatgtatacattgtggaatggctaaatcaagctaatgaacatgtccattacctcactaatgtatcattttttatggtgagaacattaaaaaatctgctgtcttagcaattttcaagaatgcaatacatcgttattaactatagtcaccgtgttgtgttgtacaatagatctcctgaacttattcctctagtctaactgaattttttgtgtcacttgactaacatcttcccactacctccagcctgccgcccctagtaaccaccattctactttctgcttctatgagttctgcttttgtagatctcacatatgactgagatcatacaatatttgtctttttgttcctggctgattttagcgtactatctttcaggttatccaaattgtttcaaatgacagaatttctttcttttgagaaatgtccattcaggccctttgcccatttttttttttaatgtatagtatattcagagctcaggtatgagcattgtaagtaagcaagctcaagcagagtagagagcctaggttaggaaatatcaataaggtaagtttatagggaaaccagaaaacaagaaagaggctttagattttatgtgaaaataaaaaggaatccaccttgtaaaactcaaaagagtctaatatttctttgataatttgctctgctaacatttatttgaatctttagcataaaagtcttctcttcatacctcatgcattttattcttcattttatgcccattagctcttgtagtgccctgagtggaattcaaatatatatgtacctcattacctgcacagtacatctcttaaaacaaaatccaatggacccttggatatcccagtttgaaattatctataatgtttagtatcccctttggaattgaagcctaattttctgcaggcaaggcaatgtcattcactgtgtacacttaatgcttatggtgcttatggtcaaaaccttgaaccattttggttcttccaagaaccatttttatagatttactgttttaaatatgaaatatagaaaacctatatttattatgtggtaggttacttaaactgatattcacagaattttaagatcttaatgatacagcagcatctaggtatgtatagaagtagtttagaaaaatgtgtcttttgcttaaataaaatcacttcacagaagatttgtgaaatggcaaagtaattacaactaaacgaatttattagaatatagtattttttttcagatggatttgaagcctaaaatctcattcatgaataaaatgattaaaatgattattttggtaaagtatcatcccaataatccattgttgtattcaaggactcttcacattttaataaatatgttaaaagagagagggtttattaaattcacatcctattttccttaatattgcactaaatgagtgacctaaagagaacaattgtgtctatgcttatagcttatatcatagctgggcattcaggggaagtcaaatcactccatatattttaaaatgtttcctctaatatgaagatatagtctttctcttgtgaaaaagggacagatctcactcttagcaatgttagaattttggctgaaagctatgaattcatatgtaagtgtggagaatgatgttggagatttgtgttaagattatgaatcaccaaaatgaacaaaaaatttaaacttatgtgaagattttaaagatgttttctctggaaagattacattgataagcaatcaatcatttacatgtaattaaaaaaataacaagcccaatacagggttttttaaaaaaatcacgtcataaaaaagtaaatataacaggctttttaatttttttcaactcagtaagctttgagtgcctgttaggcacattgtgcctattcttgacaaaataaatcagatagttataagttataaaagaaaaggaaagatgatataacaacaaaatgaatgttagagtgattagtataattgctatgaatggtcactataaatttttttgtgtgcttggatatttacttataaacatgtaagttttttttctttttcttttttttaatttttggtgtcatcagaaaaaatgcaattctttaatatttatttcattttagaaatctacatataagcttatcaaattccaagttggtagttattgcaggtaaaggacattgagtaaagattgcacttttaaacattatggttaggatcttaggaaattatcctgaactttaaggactaaaaacaataccctgtcaaagaaaaaatgcatcagacagagttaaacagctgcgaggaaaactggattccatattattgcaatagaggagagagactgaacacaactccgctaaaacaaaaggcagaagtgtttttaagtgctggattgagcttgcagaaaagttctagaggacattgagtgagggcatggttggtcaatttgattatgccatctttgtttactaattggcacttatttaaattagacttctaccctcccacagggagaggcagctagcaaagctatctttttcaatggctacattttaaagggatggctcccaggtccttgagaaatacattactggattatgaaactgacaggtggttgacacaagatttgcatctcaaaggggcagagaatggatttacaattgcaagtttcctgaagtaaataccctaaggaaaaggaagtcaggaggccatagacaggaagaaacccacctaaagtttagtcaaactgagggaaacattaagtctatcttggtcaactcttcagttatactaaattgtaccatgtacattgacaatatttgaccatttttgacctacaaaagcaatgggttcatatgactctatctaagattctaggatccagtttgtttttgtattatttttacattctgcagaagcaaacaattctccacttatggtttttagttttacactttcttatttcaaaaaggacttagggggattttatgtgtatttacattaaataatatatatatttatgcatatgtttgtatatatctgtgtgcttatttaaaaaaaggttaaaattgaagttggcaaaaataataataaaaaaaaaggttagcagaagtcttgaatacttcctaaagaaatgtcacaggtttgtttcagagcttcccataagttaatgcaaggaaagaagtgtagtaagttgcagtaatgaccctaggagaaaagcaacccagaaatttagaataatagttttacaggtgttcagacctaacacaatttttccctttaagtgctcataaaggcaacatttgtgtgttggcaacttgtccactaagcctaatagttgatttcatagtctgggtttttgctcgttgattgtttttttttaaatgatgtctctcaatgcaaacttggcaaaactccacagtgtaatttagtaaaagcaatttgattaggtatgaaaataacaacatccagatacacagtcctctaaagatggaattaaatatatctagaagaatgaattgcatcagacaatattccatatatatgtgtatatatgtgtgtgtgtgtgtgtatatatatgcttttttttttggtaaactgaaccctcgataaaaatgaggcaatacagcttggaaacttttgaagttaactgttgtggtgtcagaatttggagttcctttgcctttacagatgtaagtctatatgccgtaacaattttaccaaggacaggatagacagcctcttttggaatgtaaacagacaagttaggatgtggatgaaacttcatagctgcttacttcactggcaggccaatattattattctggcagtcagggtccagctaaaattagaattcattaaaatcatggttcttgctttattccttgatagccactcatatgcgcttgtatgcacacaacaattttcagagtgtgctttatttttgtgcttttttaaaaatatgatggcctctatgttaaatggttttttataggtaaatattatattttattaatccttgtatcattaatactaatagtaatagggcacgagaaatattttgtttgcttatgaatgacttaaggaagctgaagtttgatatttaaaattataaatataaaatgtaaaattgtcagtaaacaatggactgattccatctctcctttgccccatgttttccgctttgcagtaagtaaaaaaaccacaaaactttgggggtcaaggtcaccaagtctcaaacgtggtggcagacgctgctagttttctgccagtatccacttccccaccttccttaccgacaggcactttggtttacggttaggacactagatgcccggaataatggctgcattttccaattgtctttagagtaagagtggccaagtatctaaactcaggccaataaaatgtaggcagaaatgtcatgtgtaaatgttaggaagcatccttcttttcttcgtcctcctttctgctggcaggaatgcagacatattcgctggagctcagcaacctcttggaccacgaaggcaaacacatgattgagaagggtggactacaagaaagaatacacctccttccctggtgtccatggagttgccatatatgccttggccttctcaggtcgagatttatttgtatgaaagaaaaataaactttttttaagccactttatttagtggctttttcttaaacttgtagcccagcctaatggtagtcatttggggcacatctttggaaatccttcccaactccctgagactgggctggaagcccccttttctgtgctcccacatgccctgtatgtgcctttattagaacactttccctattttattgaaatcatcttattttacataaaacattatttgagcacaagaacaatgtcttattcattcatccctgagctaaagctaggatagtgtacgttcacataggatatgctcaataggtatttgtttaattgaaaaacactggattaatgacctgactgaataaagtgctaacagtactatggaattaatttgattgattttgattcaaaatcataggacactatagtagatgtcaaaatacatgtgtggagatgtttgtcatatttgttacatacataacaccctggcttatctcccccatgttaatcaatataaatcatttttcctattatttagtggaataatttaattcactaaataatttagtgaataatttaattcactaaataatttagtgaataatttaattcactaaataatttagtgagtaatttaattcactaaataatttagtgaataatttaattcaccgtcttatttagcgaataatttaattcactaaattatttaatgaataatattttgttaaagccttgggtgtgatggcaacttgtgtcatggaattcttttctttctttctttctttctttctttctttctttctttctttctttctttctttgctatgggctaatcaggatctttgttctaatctttttatcacaggtatataaaactgatttggagagtataaccatatgagaaaatatttggttcctccaaatcacattctctcatttccctgaattctctactccggggatttaacattttattaactgttcagatggttttaaaagtaaagcattcagcttatcatatggttggtttaattttatctttggtttattacatgtcttatattttaagaaaaagatcatattttttgtgtgtatcttataccatgacaaaaccattgatttggatgaaataaatctgtgacaaaccacatagaccaggtactagagatattcatttatttcttttctttataggtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggtgagtgaatggttttcttgccttaaatgtaaatgaaaatatatcatgagcagtattttctgagggagtcgtacaggcagaacttgggcagagagaaaacttaaaaatctggtttccaaagattattgtcccatgttagcgtaaagaaagcaatctaggattagaagtctgacactttcagtgctatgatatctgggggctctggaaaggattgaagcctcgcactgaatcccagtgacctccaatacctttcttcccagcacaccctaggagagagaagtaatattatatcctttcagtattccttgctatcggtatattcccagatataggactagcaagctatatgggtggctgccagtgtggggtagatatttgctcatcagtacttctttgcttcaggttttatatttcaacaaatctacccagattaaactgaatagaactgaaatacggaatagaaaaatttgttatagatgcacatctctaaatagctggcattctaaataatctttgactttcagtgcatgtttaaaagctgtttgggatttaaaaaaagaagtgtaaggatatttttctgacaaaaaatgagcttttctatagcaatgaagaacaatactagtagggataaatttgaaggtattttattgaactttgacttttttatataacgagatgagtaagtgacatttatataaatttacagtattcaatacatgaatataaggaaaatctggtaattttttccatttctttaagaattcattttatccttgctcttcaatttgtgctggaaatgtagatagcatcagattaaacagttgttactggctcaacttagctccataaatttatttttagtgaagtcagcaatttttttagggcaaggatgtaattatttgtttagattcggagtcatgtttctgaaggacccactgttcatggactccctagaagatatccttggatcttttggcctgggtgctaagaatctcagtttgaaaaaaaaagcattaaagaaactaaagtataatcaaacaaatttcatttaaactttgaattattactgcacagtatgttttcttattatattattattaaaattaaaagtttttaaaaatgtaatttttgtagaacctgtgagtcattttgagctcctgggagaccttgacacgtttccttaaaggaattatactcctggcaaattgtgtgtaggagatgaattctcaaaaagcagggagcatgtcaaagaagggggacaggagggttggggaaaggaaaaggaaagggcaggagattgaaacaggtatgattgttgtatttcaagatagtgtgcagtgcagcctggttcacagggtcagggcaggactaacattgaggcctggcctcggtgcatgcttctattaactgctttgatgtgatatgaggatatgattgttgctccaaaacacagtgaactccgcaaagagagagactgcatgtcatggttccagcccaattgtccagcacagcacctagaatttagtagatattctgtaagtgcatgcttggaaatgagtgaaaaaatgcaaagcaggtaattcaatggtaaataaatgttatccttctaaaagaaagctttaaattgtgaggctatcttatagaattcatctatgtggaatttgtaagaattctttccatgttacagcttcagattttatagaaatgattcttggatatttttatcagcactatcctcgattctagctagtgttctgcattagatttccatgcagggagctattaatttgttttaccagtgtcacccccaccatgcagctgtgaggtgtttggcatcctcattctcccacttagcatttgggttgcccaagtgctggcagcaaaggagacaagaaagtaaatctaaagcatgcaaaacgagtcactgatttatgtcactgatacctagtttagacatcgttaaccttctattttttttataataacctttgtaattcttctatattcctaacatcttctaatttttattttggggattattgttttataaatattttaacaggaatgcacagtaactcatcattacattaatttagttaagctgttatagtccctcatcgggctctctgttttgaaatccagaaacaaagacatgaaaatattgactgatatgggaaaattaactgggttgaaagattactaatttaaaataagacatgtaacatttaagtgtatgccatgcttgatttagcctgactagtgcattctctaactgttgtggaaaactacatgggaatctaaatcagaagtttggctgataaccatataatcataacaaggagagctacatgcttccagtgttcaaaggaatcaggataggatacacttggcaggatacacctgtcaatagaggatccacctgctaaacacagaggtcagcctcgcagggcagcttcttcgtgtctaggagttggattagcactgccaatgtttgccccgatgattctgagttccacttctgccagactctgtctgcttggctgtcttgtcaatgttaccactgagcttctagtcaaaacttcctgcaatctgtgaacagtgtagtctgcctactatgacatcgtattagttgaccatatccacgtgttgattttaaaatgtaactctgaggttaatgtgggaagtgcaggatgcctgttgtgactctcgtagaaaacctaggaattttaaaagcataggttagtatagttacaggcatatttacaaatacctaagcaattctcccagcttttaaataccctgtataagaaagttatctttttatacattaaagaaacttcttgctctaatagttatgtgtatgatacttgaaaaaatatataaataatttagccatttcatgtaaaatctaagaaatatatttaatctaggaaacttccaagtttccaggaaactacagtctcagttggaaaaaaggaatagtggaacttgattgtttcatgaatcttcctatttagtaaataatgatcagagagagacaatgagtaagttgatgctcgttgaaatagaaacaaagggatgcgcagaatctgttgcagaaaactacgaataagtgacaggttccaggctaatctgagggaaagaattgtttctggtagcatggataagtaattggagacaaaatactggtcagcatatgtacagtaacactaaaatagtgggaacttagtgtgtagtagggcctggagattagcaaggaattggtttagtagtggagggtctcagtatgttgatagagatcctagtgaaggctcaactgattttgcaagatgacatctttttgacccaaattatttttcactgtgatgcctgcacacactttaattttggtccccaaatctgttaaagactggacagcatcttgtggaggtgatagtaattcttctagagccatgtatgggagaaagaagtcactggatgaaaggcagaatccaagtagccactcaaaaactagtgagcatctataacatgccatgtcctgtgctaagcacagggaaacagtattggttaaaagtaatgactgctctttttggagctcatttataagccagaagactgataagtgatcaaatagctctgatttaatgtgataagcgctttaaaagataaaaggtacgtgcagaatgtgtttgaaaacaaaagggatatttgttttgcctgcttgggatgaaatgacttatttttcagaaatacaaatacacctcttgcatttattccttaatataaagaaataaactaattgcaaatggtcaaacactacagaaaaattatatagcagaaactaaaaatgacctaaatcttataattcacagaaaaccattgtttaaaacatttatgtatattattttctgcatatattcgttttttttttttgcaaaattagactcaaaacatgtatgatactttgccatcttctgtttttagtgaacagtttctatggccctcactccatttggtggatatagagccacatcatcacctatagaggctggtgtatcattgcagggcagtagtgttgtttagccatctaggttggaccttcagatagcttccacttttcttttatacgattgtaaatatttctgctgtggggaaaattattcagagattattggtcacaaagtactgtgccattcagggtatgcagcagagccctatcttgttgcaactacctggattgtagacatcaaggccctggaagaaataacgtttctgcgaaagagacttgttaattcatcttcttttttttttcagttttagaaaagggtccattatgtatgctcacccttttcccagatttagttcctcataaacatcaagtaatgtgctggtaactgggaaatactgcagtttgttagtagaattttatcagaagtcaacaaaatattccgttttgcatgcctacagattggaaaaataacaaagcctaagttgggtaagttattaatgttttgactaaatttagaaatggtgaatgatcttcattacatatgtatatcatttaaaatactattatgaatgttggcaatttcaataacactttaataggaaataaatacatttgaattattctctttatccaaaaataatgattttttttaggctgggtgcagtggctcacgcctgtaatcccagtacattgggaggccgaggcgggtggatcacttgaagtcaggagttcaagaccagcctggccaacatggtgaaaccccatctctactaaaaatacaaaaaatttgcatggatggtggcgcacaccagtagtcccagctactcaggaggctgaggcaggagaattacttgaaaccaggaggcagaggttgcagtgagcagagatgacaccactgcactccagcctgggtgacagggcaagactccatctctaaacaacaacaacaacaacaaaaacaaaaaaagtaataatttttttttagaattttagagttcagaaaaatgcaaaattagaaatgcagaaagttttctttgtcagattattcacattacttataatatttatgtctaacttcttatttaatgaataaatgaagaagttgaatcattctatattgttctttggcacctgcatttaggatgagaaaattctggagagacagaagcagccacttcattttaaggaggtggaatggggaaatcaaactcttatctcaaaaattgctatagccactgttttgcaaactacttgtcctatttgtgctgctaaattgcaggctctcagggacaatactaatgtacttgtatttgcaatggcagaggaagtagagacttgaactgtctctatttgtggaacaatcaggacctgcagggggaacaatgtggataaatagagattgtaagggaagttattagccccggttttatagtaaaggaggaaaagtcagaattttgaagggtctattgttgtcaagaaggaaaaaataaagagaaaggttagatatgaatataaggctgatatttctaatttttttttaaaaggagacctctgtgtgataggaaaagcttagttgtgagagataatatgagtatttctcagtggtaagttcatgttgaatgaatgactgtttcattacggtactgagaagagagtgggtttgagaacctgaaaccaaagaatcttcctgttaagtggaaatggtcagcttgtaaaggagtagagacagagtagagtaactcaagtttaggggagcataaattaagagaaaataacctaggaagagaaaaaaaaaaaagaatagaatagccaaaacaaaagctcaagaggaatgaaaaatgtgtcctcccaaattacataaaactttaaggtaaagtatcattatttgggttaaagttaaatttaattaattctacaaaatgccaatgtctttctattcaaactatgccttttcaaattgaaagtctttcattagtaaaatgattaatactattttgatttgggattgacactttaattaaatacactacatttttagaatccgcaaccattttttggctttgagctatgtgcctttagaataactttttaaaaattagacatttataagagacttggatatttttcttcttgtatctccctcaaattatttctctttgaatagtcaaataattagtaaaacactatattttaattttgtctttaaaaactaatgccaactagacataaatcacatccttgaaaggaattgcttggtaagttttggtctagatagaggagtttgatttcctgtgcatttaatgagcctgaggttgcaggttcaaaccccacagggactaataagttctattctctttcttttccaaagcctactagacctgtaaccttgaccagccctccttctcaaacttgccattggtcataagtcattagaaataattgattgattatcaccagcttacaaccaggtttggggaaaaatataaacatgaaaatcaagtgttctttaggggttgataatgggtcacatatatcatcttccttttgaatatcatccaggtcaaataatttagatttatgctttgaaataagacttttcatcattctcaaatgaaccataatttactttcttgtggaagatctacagtgaattatcacaccaatatttccttagactgtagaagctttaacataaaactgggtagtccattccaaaccttaaggctagagtttctaaacaccacccatttgtggacttgaacaattaggtaaaagaccagcaaatcgtctacgatataatttagttatcaaaatagttatgtaggctaagagatgttactttcagcatgatcaaataaaattgactgtcaagtcttaaacactattttctgtaagtgtataaaattatcaacattgtgttatcctagtaaaaaaaataaagagaaaggttagacatgaatataaggctgatatttctaattttttttaaaaggagaactctgtgtgataggaaaagcttagctgtgagataatatgagtatttctcagtggtaagttcatgttgaatgaatgactgttccattacggtactgagaagaaagtgggtgtgagagcctgaaaccaaagaatcttcctgttaagtggaaatggtcagcttgtaaaggagaagagacagagtagagtaactcaagtttaggggagcataaattaagagaaaataactgaggaagagaaaaaaaaaagaatagatacattctccatcttctttcatgtattacattttgtttggtttttatttgtttttaaaatttccagcttgattataaaactattccagtttaaacaatcacttttcattaccattatatggtcaataaaagaattcaatgcattcatttacactgagttttatgtttcccttttttttttttttttgagacggagtcttgccctgttacccaagctggggtgcagtggtgcgatctcggctcactgcatcctcgcctcccgggttcaagggattctcctgcctcagcctcccaggtagctgggactacaggtgcgtgccaccatgcccggctaatttttttgtattttttagtagagagagggtttcactgtgttagccaggacagtctcgatctcctgacctcgtgatctgcccgccttggcctcccaaagtgctgggattacagacatgagccaccacgcccgatctatgttccacttttaagggtaggttcattgatatgagctttgagaataatttaaagttagtttatgaatgaataattttaaaataattcttgctcaattagagataaattagtataatttatttctaaacaggcagtatattatttttattaaattagaatttaaaaatatttatattcattcatttctttattcaacaaatttttgagcatctacattgtactatttttaatgctgtggagagaatgatgaatgacagaaatttctgctctcatgaagcttagattaatttttatctatatctgtgctgaagacagatatagataaaaaatatgtcagcatgacagatagtgatatgtattttgaagaataagcagctcataaagatagagtatgatggtagaggattggggagttggtatgaagaggctcctcagaagtgacatttaagcagaaatgaactatacaacttttagaggaaaaccatttcaggcagagaaacagaaaggacaaagaacctgagactgaaaagtatctggtatgcttggggaactgtctaggaagccaggtaggtggaaaacagccaataagggggagagtcccaggaactgagcttagagaggtagcagggaggcatgtaggccaagagaaagactggagtgtgttctaaatgtgatgggaaattttgccctcccttactaggttacaggtgagagttcatatgaaatgtaaatttagagaaattcagtgataggaataattgagtgttgaaagcagagtcttgacatgatctgatttctaaattcaaaaggatttctctatgttcttcaaagtttatgaaaataattcatattgtatccttaatataaacatatgacagaaaaataagatataataaaaaaagaaaagataccaaggtaatggaaaaccattttcatgaatataaccagtttctcattattatacattttaagagattcaacaaatctgacacatctgaataattaaggacatggtatgtgttttgttttgttttattgcattttattttattttttatttttattttttgtttcttcttaaaaaaatgggatatatgtgcacagttttcaggtttgttacataggtgtatgtgtgccatggtggtttgctgcacctattgacttgtcctctaagacccctcccctcaacccccaccccccaacaggccctgatgtgtgttgtttccctctctgtgtccatgtgttctcaatgttcaactcttgcttatgagtgagaacacacacggtgtttggttttctgttcctgtgttagtttactgaggatgatggcttccagcttcatccatgtccctgcaaaaacatgatctcattcctttttctggctgcatagtattccgtggtgtatatgtaccatgatttctttatccagtctgcagttgatcggcatttgggttggttccatgtctttgctatggtaaatagtgctgcaataaacatacttgtgcatgtgtctttagagtataatgatttatattactttgggtatatacccagtaatgggattgctgggtcaaatggtatttctggttctagatccttgaggaatcaccacagtgtcttccacaatggttgaactaatttgcattcctaccaacagtgtaaaagcattcctatttctccacagccttgccagcatctatggtttcctgactttttaataatcaccattctgactggcatgagatggtatctcactgtggttttgattttcatttctctgatgatcagtgatgttaagctattttgcatatgtttgctgcataaatgtcttcttttgagaagtatcttttcatattctttgcccactttttgatggggttgtttgttttttcttgtaaatatgtttaagttccttgtaaattctgaatattagacctttgtcagatgggtagattgcaaaaattttctcccatactgtgggttacctgttcactttgatgacagtttattttgctgtgtagaagctcattattttaattagaacccatttgtcaattttggcttttgttgcaattgtttttgacgttttagtcatgaagcctttgcctgtgcctatgtcctgaatggtattgcctaggttttcttctagggtttttatggtttggggttttacatttaagtctttaatccatcttgagttaatttttttataagatgacggaaggggtccagtttcagttttctgcatatggctagtcagttttcccagcacaatttactgaataggagatcctttccccattgcttgtttttgtcaggtttgttgaagatcagatggttgtagatgtgtcgtgttatttctgaagtctctgttctgctccattggtctatatgtctattttggtacaagtaccatgctgtattggttactgtagccttgtaatatagtttgaagtcaggtagtgtgatgcttccagctttgtccattttgcttgggattgtcttggctatacgaggtcttctttgattccatataaaatttaaaatagtttttttctaattctgtgaagaatgtcagtgatagtttgatgggaatagtattgaatctctaaattacttcgggctgtttggccattttcacgacattgattcttcctatccatgaggatggaatgtttttccatttgtttgtgtcctctgttatttccttgagcagtggtttgtagttctccttaaagaggtccttcacatcccttcttagctgtgtttctaggtattttattctctttgtagtgattgtgaatcggagttcattcatgatttggctctctgcttgcttattgttggtgtaaaggaatgcttttgatttttgcagattggttttgtatcctgagactgcgctgaagttgcttatcagttcaagaagttttgaggctgacacgatagggttttctaaatataaaatcatgccatctgcagacagagacaacttgacttcctctcttcctagttgaatagcctttatttctttctcttgcctgattgccctggccaaaacttccagtactatgttgaggaggagtggtgagagagggcaactttgtcttataccagttttcaaagggaatgagtctagcttttgcccattgaagacgatattttatgtgggtttgtcataaatgttcttattattttgagatatattccatcaatacctagtttattgagagtttttaacatgaagggatgttgaattttatcataggcattttctacatctattgaggtaatcatgtgattttgtctttggttctgtttatgtgatggattacacttattgatttgcatatgttgaactagacttgcttccaagggatgaacccaacttgatcattgtggataagtttttccatatgctgctggatttggtttgctagtattttattgagaattttcccatccatgttcatcagggatattgtcctgatgttttctttttttcttgtgtctctttctgggtttggtatcaggatgatgctggcttcataaaatgagttagggaagagtcccttcttttcagttgtttggaatagtttcagaaggaatggtaccagctcctctttgtacctctggtagaattcagctgtgaattcgtctggtcctgggctttttttttttggttggtaggctattaattactgcctcaatttcacagcttgttactggtctattcagggatttgacttcttcctggtttagtcttggtagcatgtatgcgtccaggaatttatccatttcttctagattttctagtttgtttgcatagaggtgtttatagtattctctgatagtaatttttatttctgtggggtcagtagtgatatccctttatctttttttattgtgtctatttgattcttctccctcttctttattagcctagctagcagtctattttgttagttttttcaaaaaaaaagcagcttctggattcattgatttttttggagggtttttttgtgtctctatctccttcaagtcttctcttagttatttcttgttttctgctagcttttggattagtttgctcttgcctctctagctctttgaattgtgatgttagggtgttgatttgagatctctctagctttctgatgtgggcatttagtgctataagttttccttttaacactgctttcgctatgtcccagagattctgctacgttgtctctttgttctcattggtttcaaagaacttcttgatttctgccttaatttcattatgtacccaggggtcattcaggagcaggttttccagtttccatgaaatcgtgtggttttcagtgagtttcttgatactgagttctactttgattgtactgtgttctccaataactcttcctgcagggaagcctcacccaatgaggaaggataggcctgaagaaacactctggtggcagactgccacagcaggtgtgttgggctgtggggacaagtcttgagacaaagcctccctggctccagcaggggaaaagcacagcctggaactagagaaatgggtgctgcccttcccctgcccagggagcttagcttgttaggcagttgcgagtcccagtgctgactgctgcctctcccacaaggagctcaaaggacttagacagcaggcagtcacaactgtgctggttgcccctccccccaggagttcagcaggcttaggcagattccagctgagaggctgtaagaatctgcctgttccagggttggaacagtaggcctggtggcatgggttcgcaactggtatcttccaatctgtgggtagcacagtttcatggaaaaagcagtttccctggttgggtagtgtgctcaatcaacacctcccttggctggggggagggggttccccatctccctgtggctctcaggtggcctgccacaccacactgttcttccttctctctgtgagtcacaccagccttctaatcaattttgatgagagaacctggataccttggttgctggtaaagaattcacatgcttattatgttttttttttttcgatggcagccttagaacactgctgcttctagtcagccatcttggcctctcccctatgatacatgttaagcatccctaatttgaaaacccaacatttgaaatgctccaaaatctcaaactttttgagtactgatgtgatgccgcaaatgaaaaattttacacctgaccttatgtgatgggtcacagtcaaaacagagtcaaaaccatttcatgcaaaaaattattgaaaatattatataaaattatctccaggccatgtgtataaggtgtatatgaaacataagtgaattttgggtttggacttgggtgccacccctgagttatctcatcataaatgcaaatattccaaaatccaaaagtatccaagattcaaaacattactggtcccaagcatttcaaataagggatactcaatctgtataaaagagatgtcatctatagaaacattttaccttgccttttatcagtagatgaattatgtttttataaattgtggaaattcagaatatacaagtcaccctcgatatccatgagttccatattcatagattcaaccaacctcagattgcaaatattcagggaaaaaaatttacaaagttcttaaaaatttgaatttggcccacagcaagtactatgttgaatccacatgaatgaagtaatgtgtaggcattatattaggtattataagtatctagggatgatttaaagtctctgggaggatgtatatagttatatgtaagttctgtatcattttatacctggaacttgagtatccttggatttaggtatccttggtaggacctggaaccaatccttcatagatactaagggatggctgtattacagttgcccaacttgtgttttatgcttatttttaaatcccctccctttcccataaactttaaggctaatttcaatatgtaaacacaaaagtgcattaaacaataaattttttttactggttgtttaatgtgcgtgtggttttagtgaggaatcaggtataacacagtacccatccaggtgctaacatgttatggagagaatgttggcataaaattactaggcatccttcttggataaaattcactttattctaaaattatgacctttctatacttttcatggtaaaatatggtttcttctatggtactggttatagatggaagatagggtgttctttaatatctttttagacagtctccctctgtcacccaggctggagtgcaatggcatgatcttagctcactgcaacctcgacctccgaggttcaagtgattctcctgtctcagcctcctgagcagctgggactacaagtgtgtgccatcacacctggctagtttctgtatttttagtagagacagggtttcaccatgttggccaggccagtcttgaactcctgacctcaagttatctgcctgtcttggcctcccaaactgttgggattacaggtgtgagccactgcacccagccctgatgtcttttttaaaaatcagaatgtaaaatcaaaaagtttggaattactgatgtaataggaattacttaaaatcggctcctagccaaagtagtgtcaatggtatatgatccgtattacagaagtcactcgtgtatctcccaccttcatttggcacttaggttggtagattcagtgtattgaaacagcttaaacattacataattgcctagaaagggctaaaaatgatcttataagcatacaaatattacagcctactggagtcttcttttactagacacacatagatcactgcctatataaggagcatggctaatcatcttcttccctggatatttgccatttgatgtctgggaaatacaccatagtgttataattacttttttcctactactgctttatagtcatatttaacatttatgcattttccttctctttttaatgattacattttctttattgggtagcattaaagttttcctactgatgggtcagacaaactcatttttattatggtcaaaatcagttaattgttcaataccatctaacttgctaatgctatttccaagtatttagaaatatctatttttcataataactaggtttgagcctttgaatgtgttttaatttctcagaatttggaaagttaaatgttctcacatttatacttacagaggtcacataaatgatatttagtgagttcaaactattaattatagatacaaggttgaattcaagtgaacattttcctttgatctaggtctgtttagataaaatggtccatgattttagcaacttcagtgctaagtaatcagagcagcctagcagcagcaacagagacagaataatctccactgacagacgattttataaacagccagattcaccaggcctccctatttcagctatgagctcatagcagaaggctgaggttctaagatgtccaccatcttttctggctgataaatttcatgtaggaggaatattattgttccagatggtttttcagcgttgtgcacactagcctcatagactcccgctgtaattgaaaattggttttgctccaacaattgacaaaaaattagattaggttaactactttttgattttagattactgatacaaagtgctttcatgactatgacaaaataaattgaaattcagactaagtgacgtccctgtgtgtattttcacttagatatttttccctgaggtttttatagtatcattaaattacattcagatacagaatttgcatagaatcaggctcattgaaattttgatgatctttttcaatctgtaatattgctagtagtgtttttatggaaaactagctagatattttaagtcactgtaaagacgatgatataaaaagatttaaaagccatctattattaggttggtgcaaaagtaattgtggtttttgtcgtacttttaatgacaaatagtttgcttgcattgtgaaagcattcattgtttacttctaggttctcatgaaataagaaagtaattttcttgaaggtttgtttgatagtcctccatagattttttttaattaaaattttaagcatttggagaataaaacatatatttagcaggttataaatgagatcaattgaagtcaaactttgagctatagttatcatcagaacatatatggggagacacatgaaacctcagcttcccagttgaaatatccacgagacatctgactactaggaaagggatggggtcatgttacacaattctggtcccaggtgctcaacaggtgctttgcaatcacaaatggctggacattcattagtgctttcagtctgactcccagctaggccttggaacagagagtgtgtatacaatattggttgaagagtttggttaaaaagaaaagcaaagcccagtgttagaaaaagaggtgacatcatttggttcctataaggctattctgtgcctaccatatgcagacacgtttttaaagacatgtggtgccttagctctgctgcccaggccaggatgcaatggcatgatcatagttcactgcaacctcgaactcctgggctcaagccatcctcacacctcagcctctggagtagctggtactacaggcacatgccaccaacccagctaattttaaaaatattttcaaaggcagggtctcagtatgttacccaggctggtctcaaactcctgggctcaagtgcccttctcacctcagtctctgtataccgacatttttttactggtcactgaggagttttgaggatatatttccagctgtgaattagcgctgtggctcatttgagctaaggtgaaaacattcctgatattcaagaaaataaaacaaccctgttcccattctgtcctgttgatttttaacatcaaccctttggaggaatatcctcagattcatgttctgtccttttttgccctttctaactgtcccttagccttttctcatcatcgtaaattattacctgacattgacgggggatttccctaaaattgtagagaattttgtagaacgaagctgtgaaatcataaaagacagggttacaaagcctgagttcatgatcaaggactagtgaagacaaagaatcttgttacaaaatgagaaaaataaaaataatattggcctaagacttcaaaatgagaaaaataaagatagttattggcctaacattactttcttcctttagtttgaaaatgatgtccttcctgactttttgttattaaaatggacattcttttgtgaaatgaaggtgataataaatgatcattgatgtcactaattgataaaatcagaagtggttagccctaaattggggttccacctctgatttccacatgtgtgctttcatagatctaagaatgtgggaactactgatctaattcagctaattactcaaaccatgtatcccgtcaacagaaatgctaacaagtggtaatccagccttccctgaaaacccttcctgtgggttctcagccagatgggctacccattatgcttttggactcttctaattaatacaagtatcccctacattggatgtaagtcttctatactaattgctactttttaattttacccagaactgtatatgctatgtctaatgtaacattttcctaattgtgttccacagaacattaattctatggaactctatggaataattaatatctattaatagatattaccacaaaaaggggggagaactacagtcaaattattttggaaaacaatagttcaaactataggttatttcagtacttcagaaatgcatttttgggataatacacacacttttcttttttttgagacagggtttccccctctcgctcaggctagagtacagtggcatgatcatagctcactctaacctgaattcctgagcccaagcgatctttccgtctcagtctccccggtagatgggactacagcatgcaccaccacacttgcctaatttaaaaaaaaaaaatttatagagatgaggtctcactttgttgcccaggctgatcccaaactcctggcttcaagcaatcctcccatcttggcctcctaaattgctaggattacaggtgtgagctatggcgactgacctaacaaaatatttttgagtataattatatttgacgcaatcagggtaagttagctgtaagtatgaccacaagacaactaagttgattagtatagcataaggagttcatgggcagccatgttctatttgctaatctatgctggatatatttcagagggatatacagtcatccgagtttctgaaatttggcctatggaattaattttttttaagcagcgaatgctatttagggcagcagtaaatcattaaacaaacattatattcatttcctgttctacctttctttaacttttcttatctaaacatgtcaattgctttaacccttaatcagttacatgatttctataccctttaactttactctaggcatgcccttgttttgtccttgcttttgttgaaattatggtgataactgaacacaaaaatcagatttgttttgacctagtgtagtataggtgctatcttctttttctatttgtatatttctatcagcattaacagaagttcatttttattttgttgtgttctttttgtctagtacttcatgtggttatcaaataccaaattagaatcctgtaataagtgcatatctatattaagaatcaacttgttagagctggtccatcaacctgtcacattaagatctttttggaatttgttaattagctttcaaagaaatatacccactcaaatatctcaagtaaagacaggttactgtagggattaacactggaaatcacgaggacaaatatcttagtgacacagtgaaactcgcagcattgcagaaatagcagcacatccaagtgtcagaggttgtgctgggacaacctcttactgctgcatcactgggccacatgggaatgagaatgtggcttaggaactggaaacccattaagatgcagtgatgcccgagtgactgtcatctcgttgcttccccccactctcttcaaggagcaggactctattaatgtctcttctagttctctggcattaatctcattcgctgacatctgacttttgttgttgttgttgttgttgtttttgagacggagtttcactgttgttgcccaggttggagtgcgatggcacgatctcggctcaccacaacttctgacacccaggttcaagtgattttcctgcctcagcctcccgagtagctgggattacaggcatgtgccaccacgcctggctaattttgtatttttagtagagatgaggtttctccatgttggtcaggctggtctcaaactcctgacctcaggtgatccacccacctcggcctcccaaagtgttgggattacaggtgtgagccaccatgcccggcctgatgtctgactttctttgggacttccaattctgctcctgctaccactgcttaagtcttactgtatatttcaaattcaagagttggcctattcattacactgctgagtcttataccctttttcaatcaagcaatgcttctactattgcaactttaatctgccatatgccttatataatgggtttgatttttgagtataactgtatttgacccaatcaggataagttagccgtaattatgaccacaagacaactaagttgattagtatagcataaggagctcttaaaatgtggttcctaggctttgcagaatcagcatcacctggaaacgtgttaaaggcatcatcccaaccctactgcatcagaaattctgggatggcattcagcaatctgtattctctcaagccctccaggtaattctgatgcatgttcaagtttaagagcagatggtataaaattatcactctagagtctagatttatggtgtgagtgccaaaaataatggctttaggcataattgatatgtagatctttctgataatattaactaacagtttcagctgctttttaaagttgttttttgacaagagaagaacattataagcatgtaagatcatgcttttattcctatttgttgtggcatttaattgatataaacactggaccaattttttgtatacaagtttactataataagcctgtattcttttttttacttttttctttctttctttttttttttttttttttgagacagagtctctctctgtcaccccgactagagggcagtagtgctatctcagacactgcaacctccgcctcccaggttcaagcgattctcgtgcctcagcctcccgagtagctgggattacagatgcgtgtcatcacacctggctaagttttgtatttttatcatggtagagacagagtttcaccaagttggccagggtggtctcgaactcctggcctcatgtgatccatctgccttgccctcctaaagtgctgggattacaggcatgagctaccaaacccggtccaaacctggattcttcatgtttaaagtacttgaaaaggaatgtgtatccctgcctattttggttctcatatatattttttaatataacagctttatcgagatagaatttacacatcatacaatttacccattaaagctaagcaatttaatatcttttggtatattcacagagttttgcttttattgccacaattttaaaatattttcatcaccctaaaaagaaatactgaacccgttagcagtcattccttctttctcactctcaccccattccccttccccttctcccagtcctaaacaactactaatttactttctgtctctatggatttgcttattctggatatcttagataaattatatcatacatatcatacattatatagtcttctctttctgttttttccccttaacataatgttttcaagatttatacgtgtcataaaatatattagtacctaatttcttaatttccaaataatattccattgaatggatataccatactttactcatgcattcatcaatggagggacatttgggttgtctgtacattttggctagtatgaataatgcttctgtgaacactcatgtacaagtttttacatggacattgttttcatttctcttgggtatatacttagaaatagaatgattggttcacctggtaactcttgtgtttaactttttgaggaacttccaatctattttataaagtggctgtcccattctacattcccacctacagtgtttgggtgtttctgtttctccacatccttgtcatcacttattattatctgctttgggttacagtcatcctagtgggtctgtgtacaatctcactgtggttttgatatttacttccctggtgattaatgatgtggagcatttttcttatgcttatcggcaatttttttgaagaaatgctattcatattttttgctcatattttacttgggttattgtatttcattatggaattataaaagttcttcatatcttttagatgcaggcccttatcagatatatgatttcatagaagttttttgggatgaagatttaaaaggtcaaatatgattcctgtgaatggagagagaaattaatgagagataaaaatattaattttcttctcaatgaaacacagggtagcagtgggcattagtacgacaattcaacaccaaatctacctattatatatgcaggatatttaattgagatttttgcttgaaatttgttgagaaggaagccagtgcagagttctgaaggaaagagagtttccataaagaatagatagctgaatattgaagagttcacacaggactggaactaaatataagttattcaacctgtgaacaatgatcttaattattggtgacacagtttctcaggaatgatggaacaataagcaaaatgcactcatcttatacgtgtgagagaggaatggaaatgaagatggagaagacttgcctccattaagctggaatgcgatgagtaggagagaggaggctggtgaggagatggaattagggtcaaggaagcagagggtcaaatctttgaaagatttgagcatgtttgaaggaatggaaggaaagtgtgtggggagggaccaatcaattgaacataaaagagaagggtagggcagaatctcagtgaggtaggcagggaagaatacagaactcacagggagctgtataataatggccattgggtcacctcttagagttcctgaaccttgctcagatgtgggatctaaacacacaggttatacctttactgttcatgtgggcctgttgacctcaatgaggtttctaatcttcattaaattccctcttctaatatatttatctaaattttctatctaatcatcagggttgggtcaattcattcatgaagaaatgttccttattatggaatactctgtattgctgagttatttttgcagtgacattctgaagtttgaggcaagcttttaattcaaaaattctcctgatatcccttataattcagtattttagtggcttaaatatacctccagtcatactacaattccaggtggcatataaaagtgggaaatggttacaaacattaatcacttagccgaagcaaatttaattaaacaatagtctaaacatttctttctaaattatgagcatccatcagatgatattccttttgtttctgtggtttatatatgaagctttcttattgatgcgatttcactatctgtagattaaatgtatggaaatcagacttttaactcagcagaaatcaggagacccagctttaagtcctggctctgcagctaactagctctgtgtccttggtcaagtcacattctttctgaatactttgcttcttcattgtgaaatcacaagatcaaaatgttaagtgtatagtcctttccagctttgttattttgtgaatctttctgttagtttggagttgaactttctctcattgtttactaacccagatccccaagtgaaaaaaaaaatgcagcatcctgatttaaaggtataatgttccataatgtcttatgttctcatggctgatttcttcagctgaccacaagtcttcaaaagagaaatcgtggtgtttccttcctgtccatggattccttcacatataactaacattgatctagagctgcttgtggagctgtcccagtcacaggccttctgaacagcatttttgcgcttgttaggacctaggcttcctgcttggtgtggaccctgattatgattactacactcaaccccacagcccagctctgctagagggtcccggcaatccggtattttcttttctaaagtctcctatccaggtctgagaactataggttttttttttttttttttttttttttaaggagagagagaagttagggggacagggggctatatactaggcactgtgttaggtgatctgtaatataattccaataaatgtttataccttttctggctctggcagctgggtaatcacaacattatatatgggaaaactaaggctaatgcaggtgaaataatttacccaagtaagcggagggaaatggtctgaacctctgacagctaacatccaaagtgttggcccttagctactctgattttgtgcatctatagtaactttgggtggaagagtactttttctttttttttttgtaaccctgggtgcctggaaaggtaggaaggaagtggggagacttgaagaatatgagaaaggaaagattggtaaccatatctttggagagcacattcatttcatttcagggtatctattctaatggaaatcatattttcccattgttaataataaatgatcatgaaggcagttgttattctttgagttgcttgtataatgatgcaagaacactgttaatcagtattttaattaggtttatagcattaaagttgtttttatatttctctatgtaaagtttccatgagtttcacatagttaacatcattggtttctggatatctaattcattttcagcactgataataggccatgttgtattagtttggaaatgtattatctatgatatgtattatatcctcttggcagctacagcattgtgttaaaatgaagcatcgcctgtaagccagatgtgtgcccttgtcattgcctcatttgaaatactgcattatgaagaaattgatgcaatgctcacaaatctataaggattattttgcatgtgtttgattaaaatgtagggagcaaaccattactttacaatacagaggttagaagttcagcatgtagtgagtgtacacttttgcccaaaagataaaaagatgatcaagactgaaactccagcttcacatagctcacagtctggtgaaagagatagatataagactgggctttcaaaaccataccataggaattaacttcattgactttattctatttacctacagggtctgaagccatacatcgtaagccaagtcagtgcagcctttaatcaaaatcattttatcatgtagcacttaggattaaaaaaatcaccacaaaattatagaatgagaaaaacttggcataatagcaactcctcaggaaaagacctagggattttatttgttcataaagttaatatacacctaaagtgtggtgagcctctatacctattacaaaaggtagaatgaatagaagtctggggcaagaacaaatgggcaagggggaagacttcatctgtgtgctatagtagttagatcacatgtagagtagggggctcatttctaaccactactttacagagaagactgacaaaatgatgcttgtctataaaaagtaaataaaaatagaactgcatctcataaggatgtttgagtttaaaaatgttagttaactttaagaccaattggagtctgtgatgatgatggtatcattaaggacaatgtttacttcattatctcatttaatgttctgacaatccagtgaaataggcgtgcttatgatcacccattcacagataatgacatgcacacaaagaagtcactgcacttcctgagatcacatgactcgggacagctcaagcccatgttcttaatgacagtgctgtgctacatcaaacataagcagttgccggtccttgacagtgttatcctaggccttcaacactgtgtgaggaaggaaagtgacttcatagcttcatcgagtataaggatacagaactagtcattggctaaatttggcagatgctgaaaaaatggcaggaggagctatcttaggtatatttcgaaatcaggggaagctcttatctttggtgtgctccttttattttcttttctctatagagatggaaatttccagttatctaggtactaaggattgtcaaaagcattcattgctgtcttactgtcttaaaattctttttttcttttttcttttttttttttttaagttggaatctcactcactctgttggccaggctggagtgctcactgtaatctctgcttccagggttcaagctattctcctgcctcagcctcctgagtagctggaattacaggcatgcaccaccaagtccagctaattttcatattgttagtagagatgggggtttactaggttggccaggctggtcttgaactcctggactcaagggattggcccacctcagcctcccaaagtgctgggattacaggcatgagccactgctcctggcctgtcttaaaattcttaacttaaaataatattaaagagcattttgttatttcttatactagttccagtctagactcttgctttttcttcttcttaagggacagaaatagaaggtttcattcagaactcaaagtgaacatcctagggcaggactgtgcaactccttcaaagaagaatgattcctgaaagcttttattactttccctggaacagcagttgtctgtgacaattacctaatttgaggcaaatgaatgacaattcctttccattcttcaaaagcaacattgcaaaagaaagctggagggaagtctagagagaaaattcttattgatattttacaaatataatatgtttcatttgttacaattcatataaactgccttcttgtaaagatgcacccagatcttagttgagcttacgtaaattttttaaaagtcaccatttcctataatataacttatataatgctatattatgcaattgtaactaacatgtgttgaacactcagtatgtgacaggcagtgttccaagtactttacaccccaccaacctggggagttaacaatgacaaatattctctctttatagacataataaatgcacagaatgagtaaccgtccaaggtcacgcaggtagtgagtgtctaaaatgtgacttgaaactgaacattctttttccaggttccaggttatgtgtacacacataatcaggtttctagatggccttttgttatccaatttgttatgcatgaaagaagcaaaattgttcattatgtggggagtctgtgaggcagtcactgcacattggctcacttgatatccaccctgctcccattctaaaatgtcttcctgcactctaaaggctggaaactagaaagccacatttttaagagtcctttactgctagacttctacctgtgctctaggttctgccaagcagattcagacgtctaagccttggaatgtgtgaaaatgaggtacgggcatggcagcaaagacatgtgatgggtacttttgtgcatgctggtctggtctttggcattatagctgttgagcagtgggcagcagcagcagcagcaaggtttcctctagaacactcttagggtatggttggaagcttctgtaactgtctactatcccgtaataaaattcttgctacttaagctagctagattacattctctgcaaacaagatccctagtggatgcagagggcttcaagcctataaagggatattggttcaggagggtctctgacctttggtgcccatccagtgctggaaaattgaactagaaggctcattttaagtttaaaatttttctgatttttaagacagaagactctgaatagggtagagaggagatccttcatgcatttgcttaagcaagtttttctatagaaattatctcctccctcctgagttagccatatgacaaaaagcattgcatttctgggagaaaatgtgcctcttgtactgccttgaagaataactaaaccaaaataattaaggagagcccaaatgaacattgcctgttatgtgaatccaatcaattctggaaaagcaataatggaatggggagttctctgatctctcttgtctttgtttttcttctcctgccctcctccaacccctaagtcaaggggaaaatgggaagggcactggaccttgaaggtggatatggtgatgtgggaagcctccctggaagggaacagtcattgagaagggcaggatgttttggaaacaggagtctgcaagtttctctggtgtaaagggaagtgtggagaagcaggggaaaataagcatggggacaggagctaagaaagagctaaggagatagtcttccatcatgtggataggctgatgattttttagcagacttttaaaaaaggcttttttaagaagattaatatgaaatcagtaagttagatgattggaggtgggaatgaaacagcaggagaaatagtgatgaagctgcttcagtaagccagcaatggcaaataaacacctgaaataaaaaactggaaacagaaaggacaagagttagcaaagatgcactggcctaacttaagaaattgttatgtaagctgggtacaaaaaaagagtttttaaaaaatgagagtgagcattagtgccatgcctcttacatataaataagaatacagacatgttaaactatagaacttgaagattaattatccttgaagcataattccaaatacaatgttggaaaaagattgcaaatatcagggaatgcaggtttgcacagaccagtcattctttttagttgtttgttagtggaaaaattatttatttcacaattgaaataactagcaccaaatatctaaaagctggtgggtttaccacagaaactctctctctctccatctagacacaattatgttttccaggttgcactaggagaaacctcatgctacgttctcatgggtctgaaaaaaggaggtcattcttttgagattgttgggtgtttctctgaggttctttatccagttgttacttctgtttttattttgcttataaatctttataaaagtgacattggaatacttaccttttaatggaaaactgcaagggtcacggcagagctcaagattactttttcttttcccacatggaaaattttaaaaatacaaaaagtattttaagtctagggttgcatctctcatagtatttaatttcaaatagatcattggaggacacatggtatagaccagtcatacaagtgcattcgattttccaggtaataaaagtacccagaaggtgttcattatgctccaactcttgagtagtatgcatcacatcagtactaagctggtgacttaaaggactctaaatctgtttacagtaacaacttatttttctcaaggtaatttattttgcacttttagccatcctaggacacattaaggaccaggaaccaagtttaaaattctcttacagcctaaaatagttatagcaatgtctactgtataaagctcatatgctttccaggggtaaatcccttggggaaatattacttttattgtagaaccaatattagaaagattgtggctttccaggccataacaaattagaagcaagaaattgcaaagggaaggaaaaggtgacagtgacaaatacagtgagtgcatcaagaagtaaaagctaggtgtttcactttaagaggatgaagagaaacagaatccttatttccctagacttggaaaaattatttgaagacctagttgtaaataaaatttgtggctaaccctatagcaagtgctggaacaatgatgtccccatccaatacctgtgcatttggatccagcattcaaagacctgcagcccttgcctttggcctaatactgctcttatgccatttgttagccccaaggtctcacaggactttcagttcttttttttttttttctgagacagtgtcttgcactgtcacctgggctggagtgcaatggcatgatctctgctcacggcaacctctgcctccctggttcaagcgattctcctgcctcagcctcccgagtagctgggattacaggtgcccaccaccacacctggctaattttttgtatttttagtagagacggggtttcactatgttggccaggctgttctcaaactcctgaccttgtgatccgcccgcctcggcctcccaaagtgctgggattacaggcgtgagccaccttgcccagcctttcagttctttaagttgagcttcaatagcacaggacctaagaaattctaccattttactatcttgcaccttgaagctcgtatgttcctgctttgatggcttaggccaataagctaggctggaaagctgatagtataaaattatttgagcttcagtagacgtcctctgtgctcaaagagatctttctgttctctcccactttagggtagtttcttccagggatagcctcaaaacttaggtgtctgagaattatataatgacctctaaaatcagagccatgggaactgagtattcagtttagaccccttctttaccctcatccttctaataagaagaatcatagcactctagagcttttagtgagataaatatctttccaaacctcaaaaactcctgagaacaatactgtattataacccagagtaataattaatttttgtaatgatgacattgagtcattatgaaaaggttaagtcatccaacataaagtttaatcaagcaatgcctgctacatgcaaaaaagcaaggaagaattgcatacattttgaaaaactgcccatgaaaatgttttaactttataaggaaagataactttaggctatttggtaagttaaattctgtgaaacgcccatgtgctgtcagtgctggttaaatgaggcatgtctgtatttgactgtgttttctcataagacaataagttattaattaataaacatgaatactatatccctaccatgcctatgaggcctgtgtctatagagcctaaattagtttatacttaacactttaaaatcctttttcagtaattcatggaataatccatatgcttggaagacttgtgagaagctgatcatacccattttcccagttagtttttaaagtagagatctgacctaaagaactgagcttacctcccaaagagaagtataaattcaacctcaataaaactgatatttcatatttgatgatgtatgccttcagatattaactggaaagacaaatttttgggggtatatatggattagtttcatttgctcttggattttaaatttatccatcatgggctgagtgcggtggctcatgcctgtaattctagcactttaggaggccgaggtgggtggatcacttgaggtcaggagttcgagaccagcctgacccacatgttgaaaccctgtccctactaaaaatacaaaaattagctggaagtggtggcaggtgcctgtagtcccagctacttgggagggtgaggcagaagaattgcttgaacccgggaggtagaggttgcagtgagttgagatcgcaccactgcactccagccagggtgacagggcaggactctgtctcaaaaaaaaattatccattgtggatgaaagtagcaatttcatgatttttacttaattataatttttacttcagcaggattgtttagtatttttatttttaatgttataataagtaatatacattcatgtttaaaaatctataataagaaaactaaggttttatagatttatttattccacaaatattatttgaatgtctgctttgtgccagcctagggacactactgggacaccttaatggacaaaaaacatcagcctttctagagtctgtctcttggagaggaggagaaggggagtgtatggaataatagcttacacttatataatgctttctgtgtgccaagcactgttctaaacactttccatatattaattcagttagttcctcataacaccgttaagagatgcaaactgttattatcgcctactttatgcataaggaaactgagatacagagaggttaagcaatttttccaacgtcacacagaaagtatcagaacaacgcttcaaacccaggcaacttggctttagttgcaggtgttcataagtattgcacatacagtatcattacgttactattctgcagaattttaaaaatcataacagtatgagcagaataaacaattcagtagaaaattttagttactgaaaaacagatgttaatttggtaatggtaataatagtaaaataatttataatttctatcccagaaaacctaaattcttctgtaagtcaatatgtatagattacccaagtagactcacacataagactctccaatatagtttggtcttaagtgaatgattcactggaaattttaatttgctctttggaagcccccctcccccagatactctcattagtaaactaccaaccctgtgcctgtaggactcaagtttttgcacaagaagagaaattcagtgttattaaattaaaggcaacatttgcttatgtttgtcatttatcttttgtggggttcgcctttaaaaaacatagaaacttaaatgatatgaagtcttcaaaataattggaattggagaaagtgagtggaagcagagataaaacaagattgaccgtgagttgataattattaaagatgtgtgatgacttgataattattgaatcatgaggattcattaggttatctgtctatgcttgtatttgccattttttcacaactaaaagttttagaaagatacagaaattatatttacaaaaaatactttaacattttgctgtagatctaattcagccagggttaatatccaatgtgaaattttgggcatgagttgctaagaatttacgttgatggtattatgcatgtggtagtataaaataataaatcatctttattaaaatgatgcctgtgttccatgaccatgacatacactccttgacttgagtcatgagggaaaaatgtgttctttctttaaaatatttttgagtaatgaatgctgaaatgtaacaaataaagacacatgctccatttaaaatgagatttcaagtctgtgtccctttagtttttttatataccacaacaaatgtttttttcaaaccacagtttgatgtcctatgaaggataaatttatttgtgcattcttttgagctctgcaaacttagaattttttttaaatcttagcatacagatttaaaatctctttttgttgttgttgttgttagtgtttttccatacagtattcatttatttctgatggctaaagccattctttacataagagaaacatttaaaatatggaaaattttaaagaaaaaaaggcatctgcagatctgtaatccagaagtaccaatcaaaacactgagggcaggggcaccttcacaccataccctggcactgccccagagaattagggagacaccagctgggattgttatgttctgtcctaaagacctctcatcctcagcaaataattccttgctcaaagcatgacacaaaagcatcatcagagctgcaggacgtttgaaagaaccaggtgatgagcatgaacctatgtgcatctgtggtcaatcgcagtttgctcttggtactctctgctggcaagtgagaccttaggacttacaaataacccaatggatgttcaacccttgtggtgactgactgatttttcccattgcttagaaagtttcttgtacataggaaatcctcaccccacatatgtgtttgctttgtgcaaaggaccaaaggatggtcctatttactctagtggaggacaatggaagaggactgcgtttgagagggaaggattcatgagctcagttttggaaacgttgaatttgagctgcctttaacacatctaagtaaagatgtcaagtaggcagttggagaagataaaatttaagttaggttggtgaagagacaagagaattttttttccaggtgagttagagcatacacaaggtcacagaggtagagacatgagggaatattatattgacaacaaaatatagtaaggtagtgccaagtatggaaaacctgttgcttatgatatgcagtgatgatattattgcatatgatatgcagtgatgatattattgctttatcagcataaaaaattggtaatgggtgggaatttcatattctttaaccaagaagcttcagaatgagattttctataattttcctgtaacctagttatcaccctaaaccagctagttatgtcatagacaataatatctaaaagacagggagcaaataggaaagtaatttcctaggaacagtaaatatagctatgatatttcttcacaggataggggtcatcacccaatagatgtaccaactcaatgacattgaatctaaataaaaacagcttgctggctctttttgttgttgttctttagattttcttgccatacgcagcttcaaaacaattacccaagctccttttagaaccatattgctccccacacgggggatctggagaacctgtgactgttttccatccttctccaacttctccacttaacttgagattgttttcctttctgagtcacagctccatatggtttctgtttccttcctcttacatagcaagctgattacctgtaatcttttcattgctacagtctgtacctttaactctaattaatctcacaaatgtatgacaaagagaaattagtagaagcagtatgggcgaatattagcttatccttattactagagaagtaagtcaacacaaatttcctaatggtaaattgataacactgtctttgcatgtcataaaccatgtgagatagttattcattagtttactacagtgtgcctggactcagataatcccaaaacacagtaacgagtcataatctagccaccaatttatatcagtgctttgaagtttttattcaaactgctaatttacataatgaataaaagtagaaatcacatgtgatctatttttaacagtctatgttaaaagtctttccattgctataagaaacagtcgatagaaaaaaacatattatgtctaaaaagttaaaaatctccaaccacttaaatgctattaaaataatcttatgaattcttctttatttccccttccttcttcttgatggtttttgtgagtaatgaaatacataacataaggtggattgaaaggtgctatatttcagatatgtaaggagtactttatagtttaagaatataggaatttcaaaaatgtaacttttctagtaaattttatgtacatattataaataattctataatgatcttcatatatatgattttggtatcaaattttactaagtacttgatataacttgtataatacatacttatcattaggatttgatattcctatatatttatactatcagaaacacaattaaaacattgttagccaaggaaaaggtgatacttctacattttaaagacaattttagctatttctgtttaacatacattttaagataataatgggacacaaattttagggaaatagtagaaaattatttttaaaatggaatctctacctgaaaaggcagaccataactgttgtacagatatactatccactcagtgattaaataatcaatgacagagcattttcagctgcaacattttattctaagagttgggggcaggaaacacattttcagctattgacacacagccaccccaaaatcatgacaacatgttgccctttttgaaagatgaaatctttaaaattagaggactttttaaagggtatatttaatagatatgctatacaactgttagaatggtaaaaaaaaaaaaaagataaaacaatttcttacaaaattaaccacatgcttgccatataacccagcaacctcactcttaggtaattacctaagaaaacttaaaaccaatatccacaccaacacctgtgctatgatgttgataatcattatcattaaaaactataaatatcattgtgcattctgaatatcatttatattcataatcattaaaaactggaaaccacctgaatgtcctccaactggtaagtggataaactgatatgatacagccaaatgatggaatactactcagcaataaagagtgggacctattgattttaacaatatcatggatgactcttaaatatattttgtcaacttaaagatgctagacccaggaagctacatatttgacttcacttattttagggatggagagcaatttggtggttgccaaggtttgagggagaggacaatagttgaccaaaagaggctgcacagatgaactctggtgtaatgggactgtttcacatgctacttgggtggcagaaatatgactctatacatttctcgaagtccacagaactgtgcatcgtgagtgtgaactttagatatgcaaataaattttcaaaaggatcaacctaaggatctcaggatggaatgcagactgagaaagaaatctaacgtttacaaatgtatgttataacctcactaaaagtagtggggggaaaagtaattgacctgaataactttagaaaacattgacattgttttcactggaaactgaaaagctaaaaacaaaaggaactgtgcatagcgataccttctggcagttctgaaaccatgttatgtgttttgatgtatgtgtatgttttagatcatgggagccagatttatcactatcagataaaagctaaaatcactaccagataaaagctaaaataagcaaagggggcagtctagaatgaatcctgtggtgttgaattagagttggagccatcaatatgcacaagataaagattttcatgctgctgataaagacatacttgagactgggaagaaaaagaagtttagttggacttacagttccacatggctggggaggcctcagaatcatcatgggaggtgaaaggcacttcttacatggcagcagcaagagacaatgaggaagtagcaaagcggaaaccccagataaacccattagatctcatgagacttattcactatcacaagaatagcatgggaaagactggcccccataattcaatcacctcctcctgggtccttcccacaacatgtgagaattctggaagctacaattcaagttgagatttggtggggacacagccaaaccatatcagatatggatacataaaagtatagatatgtgtgtatacatcgtttagtacagatacatctatttcctaggtctgtctaccaagagggccaagaagcaatgatacactattggtaaagagcagacccaatgcctagattgtactttctaaataccactctccaataaaaggactcagcattctttgggaaaatggctaattctagggctgggcagggaagatacaagacagaccttgagtgtcttctagtgtcaaaaaatgaggaagtgctcaaaaaaagaaaagaatggggcatgtcacaggggcacaggggccaacctaaatgagttcccaatggccaagactggaaccattaaagcagcaaaataaatagaatagtgctagtttacaacccaaagcataaaacaaatgtccatgagttcctacttatataaatacatacatacatacatacatacatacataaatacataaataaatagagggagaacagataaatcttccactttgaacaattccaaatactatatgtagatataaccccctccaggaggtggagcttaattccactgtgctggaaagtgggtcatatttagtgtctcacttccaaagaatagtgtttggaaagggagaaagagtaactttacagtagagaaacctgacacacaccgcctgagccaagtgatcaaagttaacgttgctggtgatacgggacatccatctcatgtaccccctgataggatgtgcggaggagggtgcctcatgtttgtgacagtgttccccaaacacatagtcctagtctaattatgagaaaaaaaattatgaaacaaagactgaaggacattctacaaaatacttgacaaatattattaaaactgtcaaggtaatacaaaaataaggaaagactgagaaactctcacagaccagaggagactaaggggacatgacaactaaatgcagtatggttccctggaatggaccctcagacagtaaggagacagtggaaaaactggtgaataatgtctgtagtttttattaggttggtgcaaaagtaattgtgctttttgccattacttttaatggtaaaaaccgctattacttttgcaccaataatagtaatatgccaaggttaatgtcttagttttgacaaatataccatggttatgtaaagtgttaatgttaggagaaactagatgaagggtacacagaaactctctatactgtatttgaaacagttctttaaatctaaaattatttaaaaataaaattttatttaaaaacaaatgaatgctgtgtatgtataatgacttggaacaattccaagatatattattaagtgcaaggaaaaacccccagcaatttgcagaccaatatgtataatatgctactatttatattaaaatatgtatgtgtaaattattcatattgcattgagtatcctggaaagtttgtccaaaaacttggtgatactgattgccttgaggttttctgggaagaagagtggcaaggagatttacttggatatcttgcactttgttgcaccatttaagttttggtacttgtgcatgcatttcttattgaaaaaataaactaatgatatgtatataaattttaaagcccagctaatctcttagggcttaagggtagtaagtaaaccctaggaaggtggggtaaggctgaggagaggaaggtcacacctttgaatcttaaataacaactatagcgtacatgggtcggaaggagccttacttttttactgaataaacttttctatcttctgatttaaaaagtacaattaactttttaaaaagctcagttagtggtggcattctagtcatacttctctgaagagatttttttctaaatctttattacttatagtctccgtgggattttttaagagttcagcagaagatgattatactcttgggaattttgatgaaataaataaagtattgattagttcctgtttggggatttaaatctacagatttcttttttctgcccttgaaaaaaatctagctaataaggttttacctcaacttttttttccccataaatcaacaatttcttttaaaagtcaacatgacccaagtaggagaatgttttaatatgttcaacttggccttataagttagatatcgagttgtaccttgcattagttttttgcagctgccacaacaaagtacaacagagtggcttaaacaacaaaaatgtattgtctcacagttctggagaccacaagccaaaatcaagatgtctgtaaggttggatccttctgaaggctgaggcagaatctctttaagctccttttcctagcttccagcagtttgctggcaatctctggcattctgtgccttgtagattaatcactccgatctctgccttctccttcacatggccttctctgtgtgtgtgtgtctgtgtccaaattctgcttttataaggacaccagtcatattggattagggcttacctaatgaactaattttaacttggttccctctgtaaagatcctatttccaaataaagtttgtatcactaattctcttcattggctgagctgtggtctagactgtcagtaattgcatttccgtggtcttcctttattcttaaacttagctgtacatcagagtcacctggggaactttgaaaaatactgatgcagcagtctcactctttagagatttagatttatttggtacagagtgcagcctgggcatcagagtgtttaaaagcattttcccagatgattcctgtttgcaacaggattgagagctgctgctgcaagccccatgcactcaaggagaaagaacgagtcagttgccacatgagcatattctgccttgggcaaggaatgggaaatgagtgagtcagtgatcacaaccctttctatttttgaatactgaataggtataaaactaattagcctcttttccttctggtgtgtgtaaggttcaagcacacaggaatattaagggaaattaaatggctctcagcaaatttagttggtccagatgccttctttaactctactatctttaagtttccctcttcccttcttgggaatgtgttcaagggggtttgagtagcagcaattgctcaggtgccacccaccccacctctggtgaatcagttagttttcattcatcagggcctacgcttgaaataatacagacatctgagagtataaacatagctatttgctattcttctttctgctgataaatcactgcttcactcactgagtcttattgttctctaaaaataatcctttcacatgcacatctggggatttttttctcatcttccctaaaatttctgtttaatccctccccaacaaagtcatctcaaccaaattggaatactaaatcttttactttttcactactgtctttatttatttgtactttccataatgattttggtgcccaaaaggccacttgaaaatactgaaatgttgtgaagtttaagtggaagtaactaccacttagacactaagcctactaaatgatctgagttacatttccccatctctgacacagacacattaattccataattgtcccagtgcacttcattgtgttcttgtcaggattagaagaataaagatagtaaaaaggacttgggaaatataaaatactctattttctcagttttattgtattcagtgatacagctgtgacaatagcaatcctagcatttcatcatcactatttgattgagctcccagctgtttacctggccaggagcaatcaaaatagaaatgagttcttatagcttgttttggattttatagtctgatgctagctacctcatccaatatattatattttgaagctcattacaaaaaaatgggtgctacagtgatggatgtgaatagttaacaaatatcatttggaatagaatttcactatccccaaagaaccctctctgaagtattatatgtgacattcagactgtgattagaaaccctcttttgaccagaataacccagagtcatacagggatgggattctaggaaatgtaattcccactttaaccaaacagatgtaacacaatctagcttaaacaggtgctactatcatctgtgttttacaaatgagaggcagggcacaaagaagtcaagtaaattactcaaggccacacagctaattagtggtaaagtcaggtttgaactcagacagtctgattccagattgcaagcttcttacccctgagttttgctgtctctatgataagataaagggttctgtagaaaatctcagtgcatttttccttgcatcaagaatccttgtttctgattaattaaagaaaacttatcatcaggctgttacataaagcaattatatgtgttgtggcccttctgttctactttttgttaataaccctaacttattttcattttttcacagaaattatttgtgttttgccctttcaaaattcactttttttcctgaatcatttcttgattataagccttccaactattttgattgttgtttcactatgtgactcttagcagttgcatgtgttgcactagtttaatgatcgttcaggtttatgttctttgtatatattctgacatcattaaagtgttcatgctccatatttccaagcatactgcaacatccttaagtcaggagtattctttatatcaccaccaagcagtgcatagtagatgctcaaaagtattttttgttaaatgacaaatcttcctgtagcaaatcaactccattgggttttgttattctggtttaatgtctaccctcctaaaaatactcccaaaagaggatgaaacacaatgaatatttttagactggaagattcccaggattttccaacactagtaaaattattccttccaatcagtttcctcttttttcaaaggtattaaaatgctgataataatatttttaaacttttattttttaattaacataaattggtcttatattatgattttatagctagagttggcagattacttgtgactgaaatactgaattataacatccaatttagactgggaaaataaataagacttaaatttgttgtgttataaaatgaaatgtctgtattaagtatctccataatgagatttcattctgaatcacacttagagacagagtatctaattgcaatctgtaaataaaacatgctccaaaatatcacaattctgctgggtagattatgacagatagatacaactaggtatgtgttttggaggagtaaattattatttttactttttaatttagtcaacatggtttattagctgctactcaaaaatttcagtctgttagtacatattatggtgaagagtaagttgaagaaaatggagaattaaagacaaatgaaaagtaaaacatttccaaagagagttttgtttgaaactacatgacaaatgttttttcaaatttctttatcaccaatttttcaatcatgtaccttccaaattctagaccatccggctgtatcattggccacagtccttgaatgtcatcacgcatctggccatttctccttcaagcaaagtgaacaaccaggtgtactgctcaaagttctgcccacgagaaagatgtcccttaccactctacttcagggatgtcccagaaaaaaagctgtagtggtgcagctgtctgttccctttcaggtggtactggcatatcacgttgaaccatttgcagaccatgcctatggtcttatcttcctctaattaagcgttcggtgtctactaaggcctggtaactgtttctcaaaaacagagtagttatctacgtgtgatgccagggctctgaatttttaagggcctgcactgtgattcacctgtagggatctgacaaaggcctggcagctctgaaattttaagggcctgcactgtaattcacctgtaggggtctgacaaaggcctggcagctttttcggtcactcagtagattagttggagtaacacacacaaatgaggaatatgttatcttgaaaagccaagagacctcttttttggttgtaggaggggccagatgcaacaacttatccttcatctcagaagagatatcacagcatgcccccacaccactggacccctagaaatttcacctaagtagaaagcctctgaatttttgtcagttttatttcccaccctggcatgcggtaagtctaagtagttgctacttcttgctcagtaggtctgatcagcataatgtcatcaatgtaatgaaccagcataatatcttatgaaggggaaaaattgaccaagattcctgcaaactatggttttatagcctgaggattggagagttgatatatctctgaaataggacagtgaaggtgtattggtggcctttccagctaaaagcaaacggcttctggtaggccttattgacagggatggagaaaaaggcatttgccagatggatagctgtataccaggtactaggggatgtgttaatttcctcaagcaacaaaatcacatctggcacaacagctgcaattggagtaggcacgtagtttagcttaagataatccactgtcattctccaagatccatctgtcttctccacagatcacacagatgaattgaatagtaatatgatggaaatcaccacccctgcatccttcaggtccttgatgatggcactaatctttgcagtccctccaagaatggagtattgccattggtttactagttttctaggtacagacagttctagtggcttccacttggtcttttgccataatgatcctgacttcacaggttaggaaaccaatgtgaggattctgccagctgctgagtatatttatttcagttatgtattctggaactaggaaaataaccacaagataggttcagggacttactggacccactgtgagacgtctttgaactaaaacttcattggtcacctgatatccataagccactactttggtgacccacagtgatgtttgggtctcctgaaattaatgttagctcaaaaccagtgtccagtatttctccaaaggtctgattatttcttttcctcaatgcaagtttactgtagtaaaaggctataggtcactttggaaaagcctgggaaaaagaattacagcatgaatttttgagagtatgctggaatccttcctcaaggagacccaacttccccttcattgaaagggtcctatttctttctttctttcttttcttttttttctttttgagacagaatctcgctctgtcgcccagactggagtgcagtggcacaatctcagctcaccacaagctccgcctcccaggttcacaccattctcctgcctcagcctccagagtagctgggactacaggcgtccaccaccacgcctggctaaatttttgtatttttagtacagacggggtttcaccgtgttagccaggatggtctcgatctcctgaccttgtgatccacccgtctcggcctcccgaaggggtcctgattctttaaagtggctcaagtctgggaattgattgagggaatatgactctgtttttatgattcaggttaggcttttgttcacttgaccaagacttttctgcttataccaatgaagtaagaatttagtaggcttcctatttcttttcttcgagaaacatcatgatcaactagctaataccacaggtctacaagactcagcgtattctgattgctgctttggcacttctgtccatcagggaaaccctgcccaccttgcctgtgacagttgagtgctgccacttggcctctgccacactgcagttcagttattcccattgaattaagttttcccaaatcaatgggtgtagttcccacagtaaggtctggtctacagagaagagcaattgtggagctcttcaagaatgatggggcctcccacacaaatttatttctcatgcttgtggtaaaatgtatatcttctggattctaccagtttagataggtagatcacaaataacaagcctaccctaacattccaatctccttgagcctttgaattttttcctctgtaataaaccaagtcaggtctggcatttccaacttgttcactgttgaccaccttttggttcatgtttcagccatccaaataaactgctggagtctagatcaataagtttggccttttccaactttatgttcctttcaccattatcccacacccttagtatccattcccacacatgttccctggatttttgtctgtgtacattagaaaactcaaatatttcttttggaatgtagcacagctcttcatgggtcacactttgaacctcacctttaggggcctgttgggtcttaaatcttgttatagatctgcaaacaaagagatgtgagagggggaggttctaaggagatctagcattgtcttgcatgtgaggcctcagaggataccatttcagtttcttcaggcaatgcagggttaatcccctcagacaaagtggtatagggttttcagatgggggtggaaagccctctaccacttgaggttgttgggggacaaatcaattcacctgggggtagggatgctgctaccactgggtgtggagatgctgggagtaaggaagccacttctgctgggagtggggaggccacttctgctgcatggagaagcttcttctactgaacagggggagacttcttctacgggtaaagaagacttaccagaatgtagggcctcaatgtccccaacttcatcagagttttcctacatatctccatcccaacttacaggatcccattgttttttcaactaataccctcattttaacagtagagaacctgtgagactaggagttcaacttgtgttataattcagccagctgcaagatgagattctgcatttgatttttgtcaatcttagccctatggctacaggagtaacaggtttccttcagaacacacatagaagacgttaggtcatttctaccacataaaaactgggaattggaacctcttagctcattctttttttttttcaccactttgtccagaaacattaggagtgaacagccaaacttactatgtttgttacttttccaaaagtatcagaaggtattatatgcagtcgctcagctccttgcttattttttttttgagacagagtctcactctgttgcccaggctggagtgcaatggcacaatcttggctcactgcaagctccacctcccaggttcatgcctttgtcctgcctcagcctcctgagtagctgggactacaggttcccaccaccacgcttggctaattttttgtatttttagtagagacggggtttcaccacgttaacctggatggtctcgatcacctgacctagggatccacccgcgtcagcctcccaaagtgctgggattgctccttggttcttataagtgatggattgagtttccaatgcaaatatttgtgtatttctgttgccagatcaaacatgtagtatcagtgctttcttcacttctgaagaggaagtcattaaaatatttacctcaaatcagattagagagccaattcagaaaccacatatatatatatatatatatatatatatatatatatatatatatatatatatatatatatagtgtgtgtgtgtgtgtgtgtgtgtgtgtgtgtgtgtgtataggctcatgtgattatggaggctggaaagtcctacaatctgccatccacaaggtgcaaatccaggaaagctggtggcatagttcaaaggcctaagaactagagagctgatggtatagattccagtccaagtctgaagacctgataactgggagcataatcattcactcctttctttatctcttctgtgaaaggtgaatttgaaacttgtcccatcaagaaatgaagtctgattccccttcccttgaataggggcagactttgtgatttgcttcagcccacaaaatccagcagaaataactttgtgcaagttcagagcctagcccaccagagttgttacatgcttctactcttttggaaccctatccagccaccatgtgaacaatcataggctaacttgctagaggatgagagagtatatcagccagaattgagtcaacccaggtatcccagccatgatgatgtaacagagtatagcaaagatcaacaaaaccaacttgcaactgactacagatgatgaaggaggccaatttagacaaacaaacaaacaaaaacccaaaaccaccaagatgagttcagccgaaattgtttatccacagaataataagctaagtaagtggttattgctttaaaccactaagttttgggttgttttgttatgcagtgatagataactgatacaccaaaggagttctttaacagaacaaaagactaatcaacattatattaaataactctatcttatatactgtatataattaactctaaaaagcatgaatagtctgaaatcattctcttattcctccaaagaaactaataagcatctgcaggctgtgtggctagaacatacttgggattctcctgtctgtatcttaccccgacctaatcttgtcatagggtggcttggcttactgtttgcttttgcatttgtatgagtacctggagcacagtctgtactcattgatccccaaaatggctgttacttctggccctctaatataactgctgagttgattcagaaacatgtaaattaaaagttgacttaatagaagttcacttattttttaattaaaaaattaagatgtaatacccattctctgttttacttattcatatatatatataactatgttttgaaaagtgcctgtctccctgcaaatacctgcacactgacacttatagcagctttcttcatagttgccaaaactatgtcctttcagtagatgaagcaatgaaaaactggtgcattcagacaatggaatattactcagtgctgaaaagaaatgagctatcaagccatgaacagttattaagaaatcttaaatgcgtattactaaatgaaagaagctaatccaaaaaggctacatactgtatgatttcaactacatgacactctggagaaggcaaaattatggagacaataaaaagatcagcagttgccagggattactcaggagagagggatgaataggtagagtacagaggatttttaagggcagtaaaactactctgaatgatactataatggtggatacctgtcattatacatgtgtcagaactctagaatgtatatcaagagtaaatcctcatggaaactatgggctttgggtgataatagcacgtccatataaatttatcacttgtaacaatgtactattagtttggtgcaaaagtaattgcggttcttgctgttaaaagtaatagcaaaactgcaattacttctgcactaactaaatactctggctgtgcgagagtgggagcagggggtatatgaaaactctgtagtttctactcagagttgctgttaccctaaaaattctctaaaatataaagactattactaaaagtatctggactatggattatgtattaaactaaatgtttccctctctttttttgtggaaacatttcagaattgttgaagtatattaatgtatacttatgtatgtacatctgtgacaggctaacacatgacaagatttaaatctttgaaactgatactatcttgagctacttaattcaccatcagtgtaataatgctgggatttgtctgaagggtgagtgagttctcctttgaatctgattgattttccccagaggggcattagaattcagaatgcatttctaatcagtttgctgtacctaacttattagaattgctgtttgattagtgcccactgcaaatcaatataacatgaagggtgtccattttaataagcagaaagactactctaagaaacagatttatcaaagaatttcttaatctgaagtgccagttgaggtcatctactaattgaataccttcattttatagacacaggcactgaaattctcaagagttaaacagtttccccaagatcacatagctgggtaatgattgggccagtactgttatttattacttgataacatctttcagcagtacaaactgtctgaaacatgtgatggaggaaggagagcatgccacagcaactgtacgtgtacaatttggataattcattgacctgggaattgccagtactaaccctgaatgtgctcaattttgagtttttcaattacatttcctcatggaggaaggggtttattttggccttctgtacaattcttgctcacccttcaaaattcagtttaagcatcatattgtttggaaagccttcactagtgtactcaggcactattgaccagattccccactacgttttgtgctacccatcagttacagccacagttctcaaccaaggggtgcttttgctctctaggagaaatagaggaatgtctggaaatatttctaattgtcatggcttgaggtagtacctagtgggtgcaggccagtgatgctgctgaacatcctgcaatgcacaggacggcccatgctcatcaaagaatcatcgatccccaaatagcgttgctcttgagaacccctgaattatagttattgttttagatacttgccaaagccaagaatggttcttctctctggaatagttacttttagttcttttaaactaaacaatgagatgaacattttaggacatcaagagacacacattaattcaaaggtgtgttttttttttcccactgctcttgcaatttttaaaacctaaaactgtgttcaacagtattcagatatgacttacattggcatcagttctttgatggtgagacttctctttcttctcctcctccccctgcttaagttcacttactttgtaaggatttagatgcacaatatttcacttacattttcaaggggagggaataagggatggctgtattactttatctcccctcttccaaaatagaattattggcttccaataagagcaaactaatatctcactggtggcaaattcagtgggcaggtccctttctcttcactaatgtcaactttatacataccaacaaatttgttttatacattctttcaattgttgctgctctttgggcaagatgcacgtgggtgtaatcgtgactgccggatctgtcctgcagatcctggccgacagatgaaatgactactccagacacaggtatgcagtgtaagagcagctaggtgactgcctggctctagtggccagagaacagcagcaagaagctggagctgcttgcttttattcagtggaggcacagtgccaaaaactggagccaacacaacctgtaggtaattaacatttattgttcccgtttcagggaacgtcaggcacgcggatgatcaaaggtgagttcctggtcaacacaagtaaacaagcctgtttaagaaaaattcccccatactcccttgtatctactccttgccttctgccttagagttatagaatagctgccttcagctattctcccctggggctctgcagaagcttcctacctttcagaaggtttgtgtcctttacctatagtttctcccaccactctgactgattccccacacatgacttagctaaggaaaatagcagtcacagtaggataaccccattagcttctcggaagaaaagaccgaccatatattctgtggtgtggtgtttgtggggccaaagggaggatggagaggaggcgaacttggcctgtcaagagggatttagctggtcattgtggctggtgcccataatctcagtgactctggaggctgagacagcagtatcacctgaggacaggagtttgaaaccaacctgggaaacagcaaaactctgtccaaacaaagaagcaaacaaaaaacaggaagggaggagggatttaacaaaagggatttaacaattatcatatacaagaaataccagacattttaaatgtactgaacacacaaagccaatgaaattgtaaaaaataatgaacaaaaaccttaaaacatttagtgtaactttaaagctcaaaggaatgacatccatggaaattaattcacaactcctagagaatgtttaagaatatttgtgatttactcactagctttattttagcgggatgatatagttgcactgcatgaaaggcttagttacagttgggcttaatgatagaaaaagaattagtttgactttcttttctggagtacataaaaataagtacatatggcctttaaaatgagttttgtgaattaaatgatttatttttatacttgatttttctccttagagaatcattttgcaaatgttttaccttggagagtatatgacaaggcctaatgccactaaatatcaaaatgaagacttttttgatttattgggattcatttttgaaaatgcttacaggaattcacacacacacacaaacacacacacacacacataagaacttttttaaagaaactaccaacaaaatctcaatctgaaaactgacaatggatagataatttcctattatttcaataacaatctgaggttagaaggccaaaacaaatttgagtttgcatttgcacttggcctcatccatttctacgaggaaaagaatgtaggtacaccaaattttctgtagattgaattatagttttaatatccctttaagcatatttttggctttgatatttcatttgccagtaaagagattcttttgttgccaagcaaaagaattaaatgagtttgttttagcttggaagctaacactcctgtaacttacttgcttttctaatcaaatccagtgattattaagtatcttttatatgtgaagtggtgttagacgttggctattagtaactcttccttagaagaaatatgtaattccttcaatattcagtaaaccagttcattagtacaaactcaacctggaaccttctttcaaaagtagacctgagcctttagaaggcagtagacttttagaacattgaaagactttcaaggtaattcctgaaaatggatgctgagccaagtgaggatccaagtgcttataaacttagccaagagaatagtcaaaaatctctgatttgaaaacctaagatgtagctaagccaatataagatatgacttagaaaggagaaaatcattatatggttgacttactggtataagaaaaagaggagtgatggaatgtgtataacaagcaactttaaaattaatatcccagagaagacaacaataatttctaacgactctattttgtattaaactcaaagcttctgaggcttcatctgtttctgttgcatctatggttttatatgtgttccccagaaatgactcatttgttcagaaatgtttatattcatccaattattcacctttttattgatttaatacaccattattgagtttctgctaggtacctggtactatgctaagtgctgaggttataacagcaaataaaccctgcagtgtttttgccctgatgtaattaattacataaacaagtgtctaattatatttgagatgagtgtaataaagaaaaagcattttatgatatgggactgatttatagagaatttgatctagtgtacaggaaagagacaactgccctatgaaagtgacacttaagctgaaacttgcatgtgggcaaactctctagtttgggaaagtcctggtatcttcaaggaattaagagaccaaagagaaggctggatgataaggagtaggaagagagtggcatgacagatcatgcacagcatttcaggccaagttaaatatgttggcctttacccaacagatacccattttgtactgtgcagtgtacaaatggcacataatgtgcacatgatggcatataattggcaccatgaaggacacagaagtgaggaagacatagttggttcattcaggaagcctctggtatcgtggaggagacaagtaaaagatgccttttctctcatgtgatatttctggaagagagggtcgctaagctttcattttattccctgtccttcacacaatagatgacacctactttctgctcagcagtaaataatacatattgattgcatgatttttaataaacacctataatgtgatgataaggccttgcctttccaggtccctgatttctgtgcaagattttgactcttagaactttggccttttagaatctagagagcttgggactcaggctactgcctctgaacctttgtgattaaaccataccaccttagatatggtgggggccccacccattcaggactgagtgagtgctaggccactaaaagtaagctattgtattatatacagggtcttactagcagtgtgggaattgaacacttcggagccaaagtgctcaggatccagtcatgactctgtttctcataagcactgtgatgttttaattttcttatccccagcttctcagcaataaagtggagagaaaagcagaacctacttcacaggattattgtgaagattaaatgtgaaagttcttagtacattcctgatgcatgttaatattaaatactcaaaaatgttacctgcatttaaattattgttttgttaggtaattctcacaattcctgtgagatactagtgtttctaacatttgaccctcaatttttttttctgatcactttcactcttgactatatctggctgccccaggctttttgtgccaataggaggtttactcagttgtattcagtagcacaaaaatcaattcccctaatcccagtaggcatcctgtgcttcaaatggtaggatggggaaattgtgtctctgggcctgaaagcccatctctcaaactgggctgtaaatataaaagctatttaaagccaaatcttggaaacaatttctggacttctttaaaattgtcaccataataacagtgtgccaacttatagcattagaaacaaacagacctttgggctgtaaacaattcctacgtaagtattcttatcaattttcagaaccaaatttatgttggcacagaaagttccggaacaaccattatcatttttcaaggtggagtgagtacgcagggagtcaggattttagacccaaaactttattctcaaataaaattatgtttatgatcaagtcaggcgatatgcaccttaatttttattggctgcgagcagactgcattttatttcttccatgtatttgggataacttttctcttctggtagttttctatattttccaaaggttttataataaatttgtattatttatagaatcagaaaaattatttttccttaaaaaagatgtatatatcattacagggtaatgacgtgtacatgtatctcttctataatcctatttatttttatggtcctatgcacaatgtgttatagaaatttactgatacatgataccttgcatttttctgaaagctaatcttgatgaataccatatgaattttaattgcttgccagggaattcatttagttgtgtatgactgacttagaacattttttggcaaataaccaaggaaaatttgttttatacaaggctcaacattgccctcatttaattttttaaatatatgctttacttttgtagaaaaaaaaaatatatatagcattcatcatataggaatcctgtttttagtaagctcttctgtgatatttttttggctttgccctcaagtttggcctaacattgcttttgaacatagtcatttgctgtaagtcctaaatgtgtattcaagcacatataggtagctgaccctgagaattgtattgtgctctccatgtactctcagaattaacgatcccttgccatactcactgtgatgtgctaatgtatgtgctagtatttttggaaagacatcaatgtcttttgagcttcttcttaagactctaaaatctttgaaaatttaaggtatcctagacagaggtagtgattgctaaacatttgttaagatgaataagagctaagtaagacacattttcagtaacactgaaaagacttttagtaggttaagggtcaataattagatttttattttagcccccatactatctagaaaatattcttaattgtacgctttctagtcttcaaagtagatccagttctcagtgcttacagtagttatcctattgtaagtaaagaaataggattaatatatagctaatgctgtatctactttttttttttttttttgagacaaagtctcaatctgtcacccaggctggagtgcagtagtgcaatctcagcccactacaaactccacctcctgggttggagcaattcttctgcctcagcctccagagtagctgggattacaggcacctgccaccatgcccagctaactttttaaaatatttttagtagagacagggtttcaccatgttgaccatgctggtcttgagctccagaactcaagtgatccacccatcccagcctcccaaagtgctgggattacagacgtgagccactgcacgcagactgctatatcttcttttaatttaatgttttataatttttttgctagtactgtgcagtagttttctttcttaaccaataatatttttagtataaataaggatctaaggagctatgtaaaatttctgaacttgaactgatttgtgttatttgggactttatttcatggtattaatgctttcttggtgttggtttgtaaatgcactgccaatgatttatcagtgacggcagatagttccaacatgaccagtgctaagagaccatgatcagctcccagttgccacagttagagtggtgtctatcctgtgtaattccgagagggaagggaccatgttgaattggagagattggggaaagggaagctagtgtatatttattttctacactgtctcaggcattgtgacacgattattatatatgggatctcatttaacatgttcaaggtcatctagcaagtatgagaaagagctagaattcaaaatcaaatctatctctccagaagcagatagtcttcttatctatactacttaaattatttaataaacaatgtatttttagatctggaaagcttggtaaagcattgctcatgtagacggatgggtgggaatgggatgttaacaaggggaagcagtaaaaaatattccagtcacagtgacatggtgaaggatagagattagaatgtgtgtttgataaacacgaagtagtttggtttggccagaacaatctttggaagattggtaagagtacagactggaaaggaaggttagcaacatgttgtaaaggacttttcaaatgccaagataaggagtatggacttaattaggaaggcaccagggagctactgagggttttgtgtggaggagcaatatgattatagctgacagcagtcttaataaggcttaataaatagtacagtctataaccttaggccaactgctgagcagaagccaaacgctgtactgcagaattagcaaaccaattactgtgaggggtgatggcctgaatttaatctgagtcatccttcacaatggagtagaaactcctggcaatgtaaacaagtatgtgaagtgacaggtgacatgtctttttggagccgacttcacttatttgactccacagtggcatgctgttaaaatgccttaacagtgccataatttacttttcaccatttaacaaatctctcatccttgtaaatattcagtgtgtttttatggcttttctgcaggcctaaaatctattgccatctgtcttattagttgtaataatgttttgccattttttattggtattaataggctttgccaaaagggaagtcatcattatgttttctgccatttgatttaacagctgattttgactataagacaacattcaaatttagttctagcaactaagataattttttaaaatttagagagtaagctacataaaaacatattagtttcctttaccatttggtaattttaagactgtgtgtgtgtgtgtgtgtgtgtctgtgtgtgtactcacctacatgcatgcaagggcaggagactgagagtgagactgagagagagagagagacagagagacagagagggaattgcttccttctcgggaacagctcctggcaaaccaaaaagttacataattaagttacttataagacacactctttttaatacattttgatggttagttctactcacacttattgcttacatagtcataaatttttgcctctttgtctgcattccaatattattttgaacttatataatttatttattatagtaagccttcttcctttttccttttaactagattgtgtgtctctcaaagacatgtttatgcgtttgatgcatagcatggcatcttggctcatagtatattttcaaatatttattccatggagtttaagtattcctttcttagaactatcatgcttgggcttttgctcattccacaagtcttgagaatatcctaagtattttgccaggtaaacagaacagagtccctctcttagaaagcttacagccaaaggatcagaaaatgacaatgtagtctgtaagtgttattggtgtaggtaaacttgaggttagagaatggctaattagaggaggtgaccttttatctgagttgtaatgcaattaaaaaggaaaagtgtaaagatgagaaaacaggagctatagttataacaacatctacacagtcatgagtgtaagagagaatcatgggatcagatcacggctaattgtgtgactgaggggagtggtgagtaataaatctggtttaacacaaaaaatcagttacaaacagatttctatattgtcattttaaagctacaatttaaaattaattggttgctaaattcttgacaaaggggtcaattgctgtggctatccattggtatttctttgaaaaaataaaaggttgtctggtttaaaaataatattattttatttcattattttagaccttataagcacatttagaatctgtatggaattagagttctaatatatatgtatacatatacataatatataaaaataatagtactttcttttaaaatttgaattttcaatgagataatgcaagcaaagtgaataccatagtgcacagcaaatgtaagaattcaatttgtattattggtatgttttgtggagtgttctgtctgtattcatgggaaagatccagtgaggtatgaagcatatttggcctggtgagaatgcataaatctggccaatgctcccttgaaagctcgtcattctggtctaatattttttaaatatttgccacttggtccaaggcccttcttatttcaccattgcttatctctagattgaaacccaaagtagcagcttttgaaggttttatttcaaaataacttttttgcagcttaatcttttgtggttggtgagatggatggggccttgactcaggaattatcaagttttctcttaacttagaatgttaattaacgtgacaaagaaacaaggttgatgcataagaaggaagaatgagtactataaggagactttaggaatattgcacatcaaatatatttctgtgtgattaataaattttttaatgtattatgtttaacacacatatattgaattgtcaagttcacttctgccttatatcagctgtgtgatctcatctgaaaaatcactataatagtacctatgtcataagatcactagagaattatacaataatttatatgcatatttaacatgatagctggcagatattaaatattctattggtgttagctattggaactccactattatgcaaatgtgacatggttatgaggataaattgtgcaaataacagagaatgtacacttcttaaaactagatttatagatttatcactcagatctgagtaaggtttactatagtgtgttatgtatagtccttattctccagaactaattatttgttacttcagactgtgagtttgaggagattcattcatttcaagtgtgattagaaaatgcctaatagtctaaatttcaaaacatgtccttgaggccaataagatcatttattaaaatttctgtttctataataacataatgcatacactgtctacaaaaactcttacttttcacagaaaaatgtcttaagtttcccaatcagcccaattttgtgatgtaaacaggacccactaggagttccaacttttaccacattcatacagtgttactactatagtgcttttctacccataaagtatgaagtattgttcagtcagggtcccaaccggaaatagatggcactctcaaaactggtaatttgaggagagtttaataaagggattatttgcagaggtttggaccagagtatgggtgactgcaaggaaagtgcagtatcctcaggggactaggagcagcattggtgatggggtgggctttaccacttctaggcctgagtggccaaggacggtgagaagctgagggctttgtggagagggcttgaagtctcagacttctctcagggatgcagtagcctagtcagtatcaagtggtcagctatagtaaagggactcatcttaaatttcaacttttgacaaaagtgacagatcactcaaaaatgtatagaattttattaaaaggaagtagaaaaaagacattaaatcactgaagaggaagttcatttggagctgtgttattgtcaaagaatgaagactgcaaatttgggattttgtaaactttagttttttattttattttgtaaatgggctacttaatatatatataatatatgtctaaagataagctataaaagattcatttgcaagtatactaatatgtttgtctcctctcacctcctttctgtatatttcatggcattgccctgttcattgctgagcaaaaattcaaatgttacaatataaagtgactctgaatcccatcactcagagataaccactgtcaacattttagtgacttttcttctaacaaaatgtctgattttttttaatgatgctaaagctccttcctgttgtttgttggtcatttttttttaagagtgctttaaaatagatctcagtaatgggattcagtaaaatagtatatatccttgctatggaacataatgcagcagccattaaaaatcatgctattagtttatttatttaccgaagaggaattcatgttcacaagacaactgaaaaaaaatgagactgcaaaatagcagctacttagatgggttaatagatagttcagcgccactttgaacctacctccagacctccagatatgtatgcatgtgtgtatgtattctgttcatgtatccacaaagatgactataagaaaagtcaccaaaatgttgacagtggttatctctgagtgatgagattcagagtcattttacatttttgtatcattcaaattctttttagcaatgagcatatgttagttttcagaaaaaagttatttttaattttataaaaatgctcataaccaacgctcataaccattacacatatagcactattatcagaaaaatataataagcaaaatattccactcctatggttttcattgatggcatcactgactccattgaaatgtcaaattttctatttacacacatttgcatgtaatgttttgggaaatagaagcacaggaacactgtgagcaattgagagttgtgactgctgtgagtgctgtgggctagaacatgcatcttaccctgacgaagcatcttccttcctcagaactcacggtgacttaaaaggatgtgctcattctgcctcctaacattctggtgaggcaggtgcgttgcaggctatttcttatcctctatttacttacaaataaagaactttgaagcacagggtggtgtattggtttgttcaaggtcacatgatgagtctgtcagcagatctgcaaagaacatcccagttcctggagtctggatctagtctatagcctgttgttggctcaaaagctaaacaggtgatagatgagctcatcatatagctagaggtatgaggagtggaattgccaaagagcctgtgagacttgttatcctgcatcatgttccattccctttgtggggctgcggacggcctcccaacagggcagttagagcctaccaaagtccccagctctgtgttcctctggattgctggattgttgggagacaggcttttagtttctccctggttctttgtttcttatttgggcagtaactaattggattttcttagtcactggatgtttttctttgccagtccctctgcagtagtattagctgacagttttattttattttatggaattagatataactcgtaactccaaacactatggaaatcaacatgcgaattggactctgcattcaaacttttttcagaaaaggaaacaattcatcctggataaatgcatacacgttattttaacccttttttaaagggttgaaactgagcttttagaaagtcagtagcccagaatatttaacttcttagggcagaaaggaaggaaagcatttttatgtaaagaggaggaaaataacttgtgctcaaaaatacctttaagtataaacatgtatgaattttacagaataatctaaggggaaaggaaaaatatttattataggattatgagagaaatttaacatataagaaactgacactgaagcaaagctgacggttttaaattacttttctttgaaagttatagcatttgttaaattggttatgaattggaggtcatatatctttatttctttgtttgtagaattcatgttctaacatttatttttagttggaagtactgaagaatatatttttcttatgaatttcttttgtataaatttccttatgtatgagaaataaatatattattctttactaatatatttactctactagtagttttatttttaatttcagttccaattttacagttacttagggtttttgtcattaagtaaataagtgatgttttaaaatcgctttaaaacattgctatatgcaatctcttatgaaatcacaaactcccaaatctgtatactcattaagatagttttgtctgctggcatttcttgataaaatatttggtattaaatatataatatataatacctaaaatagcttaaagcattaagaagatatcacatcataattagtacaaccagttaaggtattaatattttaggaatgttctcaagtcaaagagaccatgctctgacaatgcattaaaatattgtgtgtgtgtgtgtgtgtgtgtgtgtgttagttactagcctttttttcagtttaccctaatttaatgctaataattgttaaagatatttaaagtctcagacaattcagaatgtaaaatctagctggtctttatttaatttctggatagatgacctacaatgaagacccacactataagggaaactgctactagagaagaaaattaacaaatgtaagcagagtcaagatcggctgtctctgagtgtttttgaggctgtaccccatcaataaaacctgtccttccaatatgtatgcatgtatttattaatgaattatatatgaactactgcaataacatactatgtacatagtaaaacatagttccaaaatagaattattaagataagcagaaattttaacatatttaataccactgccaaatagatgatttcttagaatacttggatttgtgtcccccggcccctacaacccacacacattctatagaacactagtaaagaatgctgctcttctctagacctcttgacataattctgagctgcataattggaagttaaaattggaagattaaaaattgtttgctaattgacaagtgtatcagttatcttattgccaaaatagtagaatgcatcaaactgccctagaacttaatagtttaaaaaaataagcatttataattcttcacatgtctataggttggctgccggttttctgggcccattgtaagcctgtggttagctgcagggtggagaggcagttttgctagtcttggctgggttctctcacatggctagctgtggactggtcacatggttctcacatgcccaactcaggattgcttcagttgagacaactggtctcccttccatatgcttctcacatacttgtctatcacattcctttagaagtctaggctggttatgttctcatggtgatctcaaagaggcaagactggaaacatgaagaaataaatgaataaataaacatgaagaaagaaactatatcaaatttgcttctatccattggccaaagcaagttatgtgatggagctcagcagtagactgggagaggccatgaattgtagtcattaatgccatcaatctacagcaataagaaaatctcttttccttaaatatacgcaagttgataatttctatatagctataagagtggctagtgctaattataccccagtgttctgattatttggctgtttggggtaattctctagccatagaggctagagaagttgcatctttgtaattcagttcattggaagtttaagttaaaatttaaaattgaatttttaagggggttcattatcactggcttgggtagtctgggctctaaggaagaagaagggaagaattgtgactatcataattatgcatccatttgttccacatgtggatagagcttactagttctacataggacatcgcagtggagaaaggaagtctcctttcggagcactggctgaaaattaaggaggaaacgtgctaaaattctgtaagtcagctaaagaattgataagctccactacaaagatacaaagtctgtgtcctgtagtatatattacacacatttattatttaaaagacatgtgatcccaatgggaaataagagcacctctcttcaaacgtgaaaaaaagttaattctgaatgataactttgtatctatttttgagataatataaatgtcctagattccgtgctgtgtcttagaaaaagacaataaatatttgcttattattcattatactaaataatatttgcttatttaaagcactataaaatagtaaaaaaagactaatagtaataatatcttcactttaatcacatttaataattttccatttgtttttcacttgtatcatttcacatgaagagccgtatgacttctcagagttcatacggacccttatagaaataactaccatttttagagcactcattttatgctcacaactctataaggcaggtattttaattaccccatatttgcagattcaaaaaagaagggctttaaaggtagactgcctaaggtcacagtcagttgtagagtcagaacttgaaatcttctctttgacatgaaagccaatgctcttcaccattacatttcactgcacttaatggatattaatattatagagaacttttaagaggtaaatggtctgaatagtgcctactaaagatatggtcaaaatggtctttgggattggccaggagagacaatcccctggctggccagcgtaaatatccagcattctcaaacattctagatacaataacattagttctcaagctgacccagcccactggaccacagccttggctctgactgtgttttcaactaagtcaccttctcattgtgatttgctcccataatgaatacacagactggcctcaggggagttttattacttatcataattgattaaattagcatctagttaagtaaatattaacagagaaaaacatttcaaaaaagactacaactcttatcactgtaagctcagtctttcaaaactatatagattatctccaaagtgcacacgatggataccctcagatgaaatatttgttcgaaaatgcagtcgtcaactatccttttgaccatcctactttatcagtgcagcagtcccaggtgttcactcttggaactgtcattcaaactaaatgactggggttcatttaaggagcgatttctgtatttctggaattatagctaggttatactctagaagcaatttgaaaaaaataaatgggctaaattctgacaggtaaattagctaatccaaagatggttctaaacagagtttattctctcagcctctgttctgctaattagtgtgccagaacagttgtttactcagtggatttgtgccattatttaaacttttgctaaggcaaaactagatcttaaaagtagagaaaaaattggcttggttttgatttgtgcacgtgggcagtatttaaaccactggagatgaagacaaaatgaaaaaccatacatctcttaagagttagctctcctttttctgagtaatgaatcttatcctccttcaggagcctctgctgagagaaatataatcccatcatatcactttagctaaaatatagggaaaatgtaaaatctcaaccttcttccaagcagtcttttaaatagaataatcatttctttcctaactagtcttgattttttgtttgtttttgtttttttgagacagagtctcgctgtgtggcctaggctggaatgcagtggcatgatctcagctgactgcaacctctgcctcccgagttcacgtgattcttctgccttagcctcccaagtagctgggactacagacgtttgccaccacactcagctaattttttgtatttttagtagaaatggggtttcactattttggccaggctggtctcaaactcctgaccttaagtgatccacccccctcagcctcccaaactgccgggattacaaacatgagccaccacacccagtctgattctttacagaaaaacttagaaaatacatgtaaataaaagggaaaatatcagaattatctgtaacttagtaatccaagtaaacttttaacattttatatgtattttcttaagatttttctgtaaattcaaatgggttcagattatcatctactttttcctactaaaatatatagtatggtaatttcccctgtcatgaaatattcttcaataatattatttttaatggctgcctagtaagtgggagcaaaacttccattatagattctattatgtatttaaccagtcattttggtcatacttagattgtttctaatttttcacttttagaagagcactacaatgaccatacatctgacaaaattttccaacatctaaaattatttcctcagtgtgaattcataatagtagaaattatggaccatggggtatgtaaaattataaatctccagtgaattttgtcaatttgtcctcttgcaaggtcttatctccactagcaaatttatgagattctactttccttggactctatttttgattactataatttatttttttaatttgaggagttaaaaaatggtgttatttttatttctatttattttcttattagtgaggataaatgcttttcttatgcatttttgtattcacatttcttccttttgatttgacatattttttaaaactctcctcaagattgagttatttagcgtattttgaactattgctttcatcattaatcaaaaaaataaattgaagactaatttgggattaagctatgaaagctgagtactaaatttcactctaatttgtagatatttagcagggttttttgtttggtttggttttttttttttttttttttttttttgagacaggatctcactcccatcgcccaggtaggaaggtaagagtgcagtggcatggtgaccatggctcattgcagcctaaacctcctgggctcaagggatcctcctgcctcttttttcttttcttttctttttttatagagctgaggtctcactatgttgcccaagctggtctggaacttctgggctcaagctgttctccctccttagcctcccaatgtgctgggattataagcatgggccaatgtgcccagtggtaaaactaaaaattaaacagattatttagtttttaatattaccttttatttcatacagtcttatagagaatataatttctctctgagaatgtattttgtgaaagtacaagatttgccaataagtgaagacgataaaaataatcagcaaagaaaagaaccagggatcagtaagtccgcatcattattggtcttgtttctttcaacgtctgggatggtaaaagggacacaccatctgcagtaccatggttatgtggaccatttctgtctctgaaatgttttgttttccagagtgagtttttttatcttggaattcttagcttccactctttaaaaactgtgccaaagactgggaaggaaaggaaagcaaatagagacacctctacagaagtgagttcttggtatcatcactgcacctaatgcaggaggtggagttgacgcaggtctttttattcattcattcaataaacatggggtaggttattggattgggtatgtggattgttactttaggaggctagggaaggttgtctccgatgagagaggaaagagcaagtgcaaacttcttgcagaggaggtatgtaaggaacagcaagggagctgcaacagagtgaatgaaggggagagccataggagctgaagtcagagacaaagtcaagggctggaccacaaaaggcctgagagacagacagttttccctgacttacagtggaggggctgtgggaccagatgcctgggactcctgcttactgtctatgtgaccatctctatacctcagctgctccctcatatgggataataatatttccccctctgacctattatgagaataaaatgtgttgatctgaggtacttagaacaggacctggcaccgtaagacttaatagttttttgttattgttattttaaaaattgatacctgcctctaaaggcctctaatttctggcatatccactctactttgcctctttttgatgccttgttacatttgttttttttttaaacaattgattgaaagatcataaccgaatctatagtacttatgtcttgaaaaacatttgtatttataatagctgttttctgttcttcaggaagtagagttataagtgatggagaaaagcttcagtgtggtcttagatttcttctggaatgaaagtgatatttttccattgggtcattgagtaatttctgacttcattctgtaggaatatgatcaatttaaaagtatatagtgattaagagtgaagaccctagatacaggttgtgtgggtttgaatttgagcttcacttagttgtgtgacctagggcaagtttttaaaactctttgtgcctcagtctctttataaaattaatatgatgatagtacctatctcacagtacaattttaggattaaatgaaagtgtatggtgtatgaacattatttgctaggctgcctgactagtagtaaacattcaataaatattggatactattattataatcagcgatttgtgacttagaagtatataagtgaactaaaattagaatcactgcatcaggaaatttgttagaaatatttttgaaattatcatttccttctcttctgctgttgctaagttaaaaatggtaagaaatggactcatcagatatttcctcccattgattttaattctgcttcatggctgcgcgttttgtatactgattcatgactgtattcactgaagcccaatcaaagactgcagggcaaagcttcttagaagacttcaaacaaccaggcttgcagttgtgaatgatatgggtctcagactcatctctcctcatgaatttatttatttatttatttattttgagatggagtcttgctctgtcgcccaggctggagtgcagtggcctgatctcggctcactgcaagcctcccaggttcatgtcattctcctgcctcagcctccctagtagctgggactacaggtgaccaccaccacgtccggcaaatttttttgtatttttagtagagacagggtttcatcatgttagccaggatggtctcgatctcctgacctcgtgatctgcccgcctcagcctcccaaagggctgggattacaggcatgaattgatttttaagagaataaaagagactgatagattctccaaagggctgagaaccaccactaggggcgtcactgtacattgtcgtcactgtatattgtcatcagttgctttaacttggcagctgctgttattgtgacatgattgtggctgttttccctctcttcctgaaatattagcataggaatattaattttcttaagtcttccattatctctatgaaaaatacttgattacttggggctatgtgaagactatgttctgacaggctaatctaatcctctaagaaagtgtgagaaatgtcttagatgaaaggctagtgataaatcaatatgtgatatctcaatgtagaataaacagtcggacacctgggggcacatggtcttagttgggggacagaggctgacatgtttctgcctttagcttagtgatgaaaatattagcatctgtagcattcataattatggatgcaaattaacaaaattttctccagtgctgtttaaatagaaatttctatgataatggaaatattctatacttgtgctgcctaataccgaggaacaaattattttattttattttaattatttaaaatttagttgctgtgggtggctggtggctaccctattggaagcatagttataagcaatggcttacatgagtactaggtttattttcctcacataagaagaaatctagaactgggaagcacagggataccatgggtgcctaaggatgttgtaaggaaatgagctccttccatgttcttcctcagcatccctgcctgacatttgactttcatcctcacggtcacaagatggctgtgccctggtgcatctcatctgtattttctacaggaagaaggggattgggtaaaaggtagacattttcagaaggctcttctgtgttttttccaaaaagacttttaccaacctctcattgacctagacttgttacatggccatccctgcctgcaagggaggctgggagtttaagtatttccctcagcaacttctgttgtagataaagcaaaaggaggaagaggttggaatggatatggaggccactggtctacagtttttaccatagcagacatttggctctttgtcctgtggaattccacaatcatgccacactcatgggcctggagctgccaatgtcttttttttttttttttaaacatctagttgacaaactgtaaatgacactagacttgggcttgaagactgtttagcacatagaatataggattagaactttgatatattggagtgatgatgagtattgcatttgaggaaaactgtctaatgactggatagtgtaaatggattttgaagtattaaaaacaacttagcacgtaccgaggaaataaagatataagagttagaaattgaaaaccaaaatctcaacatcagtaagcatctcattgttacagtatatacgagactcatggcctgatggaacaccagcccatgggtcaccctgggaacccccacaccaatgcttatcctctcaaccacaaacacagatttaaaacttccctttacagaacaggaaactgaagcttggagtcattacgctacttatctaaaacctcaactgctatgtgacagtcaggattcagatccgaagttggcggaggcagggaagccacggctttattgtcctgggctcgcgttctgcctcttcccctctctatgtgatctttctatgaccacatctgctcacgcttgttccccagcttgaaattcgttctcagtggctgctctgagttggccccccaatctgactctctgccctctagcctgcaatgagggagtggaggatgccggcccaagactatcatatgctcctccagagttaacagtttcttctaattgtctttagatcccagaacagcatctgacacacttaagaaatgcttactttaggccgggcatagtggctcacgtctgtaatcccagcactatgggaggctgaggtggttggatcacctgaggtcaggagttcaagaccagcttggctaatatagcgaaaacctgtctctactaaaattacaaaaattagccaggcatggtagtgtgtgcctgtaatcccagctacttgaggagcctgaggcaggagaatcacttgaacctggagatggaggttgcagtgagccgagatctcgccactgcactccagcctgggcgacagagcaagactctgtctcaaaaaaaaaaaaaaaaatgcttactttatcagataatgtgtgatatagatataagaattctcccagttttggaggggtattagaaaaatatacaaatgttattttttttttcctctttccaccagggatggttggtttgtttccagactgattttgcgtttctcagtttttctaagaaaatatgattgtaaaatttaggtcaaatttatgaatatcttccaatattttattcagtatatttaaaacttatacatgctcagtgtaaatatttttcagtaatctctgtaataatttctctttgaattgacagttatacaggctgatgttcccttaacatggaaactaagaatagaaggatttctgtagcctgtgtgtgtgtgtgtctgtgtgttgtgtgtagaactgtagtgctttcatttatataacaggttggtatctttatttctctttaagtcttttttgtaaagtcataatcccttgcaaaatgaatgtattttttaatcatccaaaggcccattacaaaaaattgaaaggaactttatgtgttatgtaaaccaatgggccaacttttagataatcttaaaagggaaatgatggaatggaattagctagcatttaaaaactacaattgtatagcacagatggaatgaatgttatgtttatcctgtgctttcttcaaatgtagattatactctttacctatctgatttcatttcagagctaagagaaagaatatttattaatatgttcaaaatgagctggttttaacagctgcctcaggaagaaaagttcattgattttataatcctgagaataaagacttcattacctaacactctcctaaacacctgctgggtgtaaaatgatgccctacctctattgaaatgaagcttctgcttattttgtagaaggtataaaactttgaaaactaagacagatccatagagtttgggatattttagaaccagtacttcagtttatcttcctatcatggtcttccagttgctggagaaaataatagagccttcttatgaatactaaactctctagtaccagtggatttcaaggatttcctggcccttcctcatctcaggggaaaataattttgcagtctgcttgctagttcctggtcagactgacaggacaaacccattttagtctatcttatggactacagtaatgcaactctgaatagttaagtgatttgctgtagtaaagtaaattatttgctactcctctcattgagatgtaaggtctaactcttcttcccttcccttgaatttgggctggcttagtgatgtgtttgactaaaagtatttgggagaattgatgctctaagacttttgaggctggatcataagaagcctttcagtttctacacacaacccaggggacacttgctgttggagccctgagctgacatagaagtccaactatcctgaggccaccgtcctgtaagatatgctgaagatatgctaagccagtgtataggggttgtagcccatagacttctgagccatcccagatgataacatgcaacagagatgaattgtccccactcatgtgagtctaaattgctgacctaaaaattcatgagatttaatgatgataatgatgatggtgatgatgatgatgaagatagtaataatgataaactgttgttttaaactggtgtggataactggaacacctgcaaaactgtaactcagagcttttgactctagtgcctgtgctcagtttcctccctgtaactgtcagctgcccatgtacctgtgatattgtattaaacttatgatttataggaattacaggaataaaacgaatgagttatatttctctcataagaaaacaaagctagaacgaatttaaaataactctgccatcatgcttcatttttcttcatatctcctaaccaaaatggcattatgttacgtatctattcgttcgtctgtcttctttctctcccaggatataaactctatgaggactttattttgctctttgcagctttaacagcacctatactagcatctggcatgattaggcactcacagtgtatttgttgaataaatgaatgaattaatgaaagatgattctcagagaaaataaagcataaatatcactgtatctgtttagagtattattcttctgggaaaatgtgaaaaccagaatattacaaaggtaataaagcaaacatttgataacctaaaaccccaatgtagcaaatgttaagatgatacatgttcacatcatagtttttgtcttaaagaaataaaatattagagttggaggttgaatttgtgtatatttttctatttccctcttcattgtcctaaagtcaacactgttatatatttgacttgtatattcttatgcttttactacatataattttatctacaaataatatatctacttggctctgccttcaaaatataatatatttccaatccattttcacctgcccttgctacttccctagtgcatccccgatcttttctcagaattactacatcttcctaaccgttctctgcttactctctcacagcatcagtgcaacactactccatcttttcttcacccagcagccagattgatccttcaaaaacaaacattggatcacgtatcctcccctctcctcactcttccatggtctccatcatacctgaaatacaacaccaatccttgccatgttcaaggccctgtttcatccaatgctgcagtgccagccctcctgttcctgccgtgctccaggcactcctggtgcactggcctctttgctgtttagagagcacaccgagcacatttcctcctctgggcctttgcgtttgctcgttctttcccttagcttatcctcccaccgtcttgtctcacgtgagttgcttacaacctgcatttgttttttgttcaaaagtcacctcccaatgaggatgggcagtaccaactgattaatagttgaactcccttcatgaacccataccaaggttttttttttctgcaaaacttactgctacctggtagaatttgcttatgtttgtatgtatgcatgcatgtaggatgcatttatctgttttctgtctattccctcgttagattataaactttgtaaggtcagggaccttctattattctattgttttggggcctagaacaataactgacataaagtaggtgcccccaaagtatgtgttgaatgaaaaaatatgggaatctagtgttttgcttttaaaactgtacataaagtttatcatactggatgcatcttgtggcaatttgcttttctcatgtcaaagtatgtccatattgagattgatctataactgcccaatgggttttccttgcctgctgcctagacagaactgatttatgaagacacgagaattgcaatggataaagagtaattcactcagagctggctgtgcgcgagaccggagttttattattgctcaaatcagtttccccatttggggatcagagtttttaaacataatttggtagataggggcttgggaagtggggagtgctgattggtcaggttggagattgaatcatagggggccaaagttaggttttcataatgtcttctgttcctgggtgtgatggcagaactgattgggccagattatcaatctgagtggtgtcagctgattcatccagttcagggtcagcaaaacatctcaagcagtgatcttaggttttacattagtgatgttacccccaggagcaatttggggaggttcggactcttggagccagaggctgcatgactcctaaattgtgatttcaaatcttgtcgctaatttgttagtcctgcaaaggcagattggaccccaggcaagaagtgggtctttttggaaaagggctgttatcaattttgtttcagagtcaaaccatgaactgaattccttcccaaacttagttccgtctatgcccaggaatgaataaggacagcttaagggttagaagcaaggtagagtcaattaggtctgatttctttcactgttataatgttctccgttacaattttgcaaaggcggattcagattgagctctttatctgtatatctaatctatctagtccagttattttaactgtggctcattatcccacacagtttattgatccatttcactattgctagattgtagttacttacagtttttcacttttctaagcaatgctgaaaggaacattcgtttaaagatagttaccttctttgttttttccttgtagatgtataacagaataagaatttggtttctttcacttaacaattacattcatgataatagtgattgcgtttaaattattttttgctttgatgattggtctaccagcaaatgttcccataaaaatctaaaagtcattttaggaggggaaacataatatcacattttttgaaagaacaagtttgatattatgtttatcctttaaatctcatacttttctgataaaataccctaattatgaatattttctcctaaaaaaaactagaaaataatgttacccatgattaaattatttgttctggtgttatatgcatgcatgtttgtgtgagcatgtatagcagtaagatcatttgaattactgtggccccagtggtaataggcaacactactcttccactaaatcatagagaaacctttcagagagttttgcattttgtttgtcaaagtttaagaaaaagctaattttgtgacagagttgtaagctttattaaactgaacagatgaggagaaagaaatgaaactattgaaaaactcattaagggttgtaattctagagtatagtatggacagtttccaaaagaatagtagcttttatgtgctctgaagaagcatactttatgggtgatgtcatgtgttttgactctgaagctatgaatgtcactaaaacagataagaaaaaaaattacttttccaggggtgataatttttccttgctcatagtcaaattattctgagagacaaagaagctgagttcactttacttaatttgtaatttgtaacagtttagacagaggttaatctaaactttacttctacatttatctgtgctaagaaaaattaaaaatttgctaatgttaaagttgaatggattcagaaaatacaatccattaattcagcaattctgtaattagtgcctactaggaatcagatgctattcctgatgctgggcatacaattatgaataaaatcattgaggtctctacttcctttgagcttactgttagtggaggatagagataataataaacgcgtttcaatgagagagcatcccatggtgagatgaccattgctatgaagcatataacacagggcggcatgactgaaggtgaatgggtaggggtggggaggaactgccttagctgtggtggccaggtgtcacctctaaggaagtaacagtcaagataagagctgaatgagggatcactgtgcagacatccggtgacagactctgcagtacaaggaacagcaaatgaacagtgctgattatgggaacatgtttgctgtgttggaggaagacaaaggtcagcgtggctgaggaagtgagggagggaatggttggtgaggttggcatgacaggaagggggccgtggagacttgataaggagtttcctaaagccgatttcgaagagctctccttggcagcaacaccttacttgccgaccttactgctcttgacagagtctctacttgaacatagaaaatgacagaattacctttgaatccgggcttgtcagtcattcagtcaggtcttctccctaatcaccctcaattgtgaggatctgcgatgctatgaaaggcacgtgcctgttccaataattaccagtacatctgtttaatcacttaaacatttaaagcctgagttattcatatgttcatgtgactttataagcacatcggggacttctgaatatgaatttatgtcccatgtaaagaaccagtacactctctctacatgatgggacggggtgaccatcaaactgtggaaagtgggtacgttttgacgtgaaataagagtgatactatttcactatagttttcctttactatctggtgttccagaacattccttcttcgccaccatagcatgtggccctatcaaagcccctctatcttctcaaggctcagcagtctcaggtatagtaaccattctttgtgtgacatatttcgtcacccttcagtgctctgatcactcactactttattggatgttgttggtcatacaaatatgaccaaaagtgatctaaccaatcaaaagtgggtcagatggatgaagagtaaagtagagctttatattctggatgctacatccattttcactatttaaggtcaccctagcttttttgaaatccacttcacattttttttcctttccaaggagaaatttaaaataatcatctcttttagtctaaaaacaaaaacagatactgtttataagcctttcttcataaaaaaaattagagctagtaattattgaaattgatagtagcaaaagccatagctaccatttcatgtctcctgtttatgtgccatacagtcacctagacccttgcatatgtcatttctggttggcatgaggcttctatcaagtatttattattattctcagtctacatataaaactggaattaagaagttatgtaatctcattcaaattttcacttctggtaattagcatatccaggtttcaaacaagatttgtttggctcaacagcccaaagttgtaatcacctcactctctagccccatttaaaatccaaatagccaccactgtactgtatcccaagagttttatgaatatgagctcaattactcctcaccacagcctaataaaaatgagtgttttgtgcctatgcaaaaaaaaaaaatgaagatgagaagttttcttcaggaccttacaatttcaagtgacagaaaacctaagttttaatggtttaatggttcatataaagtctaggggtgggcctggcttcagtcatgcctaagcctaaaggagataatctccctctcttcatctctttactgtatgtttctctctgtcagctaccttcacacatagccttccctgcagaagtagcagaatagcttccagcagctacaggctcacatcctctctggtcaccctagaagaccagccatgcctctctccctgtagttcctacagtttctggaattgagtgtcattttccttgattggcttgacctgaaatacatgctccccctggggcaggaagatcagctcaatgcaactcaaaccccaaaagaagagaagtggtacattgtaccttccccaaaaagaaaggggggtgactattggctgagcaaaacaaacaaacaaaaaaatctttctatgtgcctccagtgcaatagcagtaagtggcatagtcaggactcagatccagattcataaggctccaaaatactttctcttaccctttatgctgtcttttatctccatataattgtcttttaaaattcattgtgagactgtgaagctcctgtacttccgttaaaaaaattattaaggaagtgatgttcaaaagcatcagcatacttgtggttaatctcttttaaaatagcaagtctatcaatgtacaggtaaatactatttctagaagctagaaactctgaactttaggtaagaaaatataatgatttcgtgtctaatttcatagatatctttgcgttaagtaaaatgtccctcttcatatctccaaaataaaggatatttagcatagaatggaatttttcttaccttataagactgcactattttctgccttttacaccaatgcaactggtctttatcaacaactcacaatctttatttcattatctttgacctctgatttagaggacagtactctccccttgggagaaattaggaagcatataagcagaaagaaatcatgtaaacaatggaaagaggacactattaggaaccaagaaaccaggatcatgatcccaatttgacattggctccctgtgaataagggatggcaaatgggttctaactttctgagatgatctccaacaaccctcttatataatctctttaatggctgttttcatgctgaatgcaatagagtttttcatattagccaataaagcaaaactcattcactcagacaaaatgaattgagaatctatgacaaggtactgtggtagatacagtgaagctgcaagatgcctcctcctaggaatttgttgtcatcccctaaaatgcattgtctaatatgtgtatgacactgtgctagaagctgggactgtagagatgtaaagaaaactactgggggcttatacactagctggagagatgtaagcaaaaagaaagataaacacaacaaggcagcatatttgatgtgtgatgtgccatgtgaacaggacaaacacccactttagaaattcagcttctaatgaccagtgcagatctttagggactgttcacacgtacattgtaatatgtgtggatctctttgtgtccatgggtatcagcatagaggtaaatgtaggagatcaaggtagggacacaaggactagattgtcaaccaattatattcaaatccagagtcatctaaataaagaaagagattgggaagcccaccacaaaccagagaaatggttatatctacctatgttaaaatgcaaaacaggagtcactagtttgtattgacatatgctgtaaatgaaaaacacaccctgaatttcccagatttaatatgaaaaaaatgcaaaatatctcaatcatttctatactgactacatgttgaaatgatactattttggatatactgaactaaataaaacataattaaagttacttattttttaatgtggcttccagaacatttaaaattacatatatggcttatatgatatggctattggatggcactgggtttcctgctttggaactgtgcaaatcatttaactgctctgatattcatttttatcatctgtaaaatggggatgaaagtagtgctgttctcacagatttgttcttagtgttaaatcaaataatacttaataagtacttaccagtgcccagcttacagttaggattcaataaatgagagcagtatgttcatgatacagacataacatgttggtgcaggacgatatagcttgtccaataagtgtggaattagattagcactactccgcttcccataatttactagccttatgaccttgggccagttacttaacctctaagtacctcagcccccacctgcatatgaattgggtttattaagagatgcatccccattgctgttcttgggataattaaatgagataatccatgaaaggtgcttagaaccttcctggagcaaaatgatggaaaattatatttgtattgttgttactgcaattgttcatattcagaagatatttgcttctttaaaaattgtatttctatttgtgtttgttactgctatggaccgaatttctgcgtctctttaaaattcatgtgttgaaaccttaatcccaaatgaaatgacatttggagttgggggcctttgagaggcaataaggattagattagatcaagagagtaaagccccggtgatgggattaagtgcccttataaggagttgaagagaccagagctttctcgctaccatgtgaggacatagcaagaaggtatctctctggaaaccaggaagagagccctcgccaaaaacctgaccacactgttacactctgatcccagatttctagcctccagaactgtgagaaaaaaaaagtttgttttttaacacagccagtctatcgtagtttgttagagcagcccaaaataaaacagttgttttagtttaaaatttttaaaatttagttcaatttgtgtttttcctgatatttgctttcctttttttctgatattttgttttaaattcagaaattctaaaccactgtgtgttatgaattcccatgtagctaaaggcatgtgctggcttttaaaagtcactgcccaccccacctcaatcaccttcttatttgacatacaaacattgtggattttatcttgccctgctacctgctaggagatcgagcagagcatttgttttcttactactgaatccttaatacttagcaacatgccaccaagtattcaccaaagggttcaataaattcattgaatgaatgagaaacccgatataaatacttacttgaagaataataatgaaatcaagttttaatatagttctaattaggttctgcatttaaagctcttatgtgaataaaatccttgagaatttgtgaattttttaaatcattgactagattctggatagctgaagttaatggataagtgaggttttactgtggctgatattcggaggcatgaagaaaatttcactgaattgaccttttatttcatcttcaactaaatggaaaaaagtctgctccatattatagagagaactgagagtggtgctcctcagcggtgggactgcgttggtaattttcaaggtggacagcagttttagaaactctaggatgttatatagataattgtagtcttataatttattgatttattcccacacccacaccctaccccaaaaagctatggtctaataggctctgctttgaagaaaagagtgcaatattttctggacagttgtgctcagtgctgccatatggacgactgcacaatttgtcctcaatcctcatgtcacaggacaatcggctcaatctctaatgaaaatgtgatgttttttctatatatactgaaaagtactgctgatttcagtagtagagaaattatatggtatattattacatggtaaactatttggtatgtagttaaagaataaagaaaagatacttccattcctttctagttctgggtgatagaataatttccaactcatcaaaatttcattgttaaaccttactatagccctaggcatgcatctaaaacatatcaagccactgttgaatagattactagccacagtttccactctcattttttcttttcaggaaggcataggatttggtttgtaattattatatccttagatacagaaaattaaaaaataatatttaagagattattcagcagttgggatttttaagtaataatttagctttagtctttgaaaacatactgaaatataaaacatcaccaaattaaaattaaaataccagtatagcatgttaacctagatgataggagtgttttatcaccaatgtgtattcctaggttaaatgtataaaaataattggtacttccccattcgtaccatattcccagtattagtattagccattgcttaatttttaatagctgagcttggatttataaacttctgtttaaaattttcattgttttttaaaaagatagtatcatctgctaggatttttatggttttgtgttttacatttaagtctttaatccatcttgggttaatttttgtgtaaggtgaaggaaggggtccagtttcagttttctgcatatggctagccagttttcccagcactgttcactgaatagatcctttccccattgcttgtttttgtcaggtttgtcgaagatcagatggttgtagatgtatggtattattatttctgaggtctctgttcaggtccattggtctatatgtgtgttatggtaccagtaccatgctattttggttactgtagccttgtagtatagtttgaagtcaggtggcatgatgcctccagctttgctctttttgcttaggattttcttggctatatggggttctttgattccatgtgaaatttaaaatagttttttctaattctgtgaagaacgtcaatggtagtttgatgggaatagtattgaatctctaaattactttgggcagtatggccattttcacgacattgatttttcctatccatgaggatggagtgtttttccatttgtttgtgtcctctcttacttccttgagaactggtttgtagttctccttgaagaggtccttcacatcccttgctagctgtattcctaggtattttattctctttgcagtgattgtgaatgggagttcattcatgatttggctctctgcctgccaattgttggtgtaaaggaatgcttgtgattttcacacattgattttgtatcctgagactttgctgaagttgcttatcagttcaagaagtctttggggtgagatgatggggttttcaaaatataaagacatgtcgtctgcaaacagtaacaacttgacttcctctcttcctatttgaatagcctttatttctttctcttgcctgattgccctggccaaaacttccaatactatgttgaataggagtggtgagagagggcatccctgtgtactggttttcaaagggaatgcttccagctgttgcccattcaatatgatattggctgtgtgtttgtcatcagtagctcttattattttgagatatgtgccataaatacctagtttcttgagagtttttaccatgaagtggtgttgaattttatcgaagcctttttctgcatctattgagataatcatgtgattttgtctttggttctgtttatgtgatggattacgtttattgatttgcatatgttgaaccagccttgcatcctagggatgaagccaagacttgatcatggtgggtaagttttttgatgtgctgctggattcagtttgccagtattttattgataattttcgcatcgatattcatcagggataatggcctgaagttttctttttttcttgtgtctcttcccggttttggtgtcaggacggtactggcttcatgaaatgagttaggggagagtccctccttttcgattgtttggaatagtttcagaaggaatggtaccagctcctctttgtacctctgatagaattcagctgtgaatccgtctggtcctgggcttttttttcgttggtaggctattaattactacctcaatttcatagcttattactgatctattcagggattcgacttcttcctggtttagtcttgatagggtgtatgcgtccaggaatttatccatttcttctagattttctagtttatttgcatagaagtgtttatagtattctctgatggtaatttgtatttctgtggggtcagtggtgatatccccgttatcattttttattgtgtctatttgattcttctcatcttccctcttagtctagctatcggtctatctattttgttaattttttcaaagaaacacctcctgcattaagattttttggagggtttttcatgtctctatcttcttcttttctgatcttagttatttcttgtcttctgctagcttttggattagtttgcttttgcctctctagctcttttatttgtgactttagggtgttgatctgagatcattttagctttctgatgtgggcatttggtgctataaatctccctcttaacagtgctttatctgtgtcccagagattctggtacgttgtatctttgttctcattggtttcaaagaacttcatttctgccttaatttcgttatttacttaggagtcattcaggaacacgttgttcaatttccatgaaattttgtggttttgagtgagtttcttaatcctgagttctaatttcatggcactgttgtactgagagactgtttattataatttcaggtttttttttgcattttgctgaggatcattttacttccaactataaggttgattttagaataagtgccatgtggtgctgagaacaatgtatactctgttgatttggggtagagagttctgtagatgtctactaagtctacttgatccagagctgaattcaagttctgaatatccttgttaattttctgtctcgttgatctgactgatactgacagtggggcattaaagactcctactattattgtgtgggagtctaagtctctttataggtctctaagaacttgttttataaatctgggtgttcctgtactgggtgcatataatttagtataattagcttttcttgttgaattgttccctttaccatgttataatgcccttctttgtcttttttgatctttgttggtttaaagtctgttttataagagactaggattgcaacccctgcttatttctttgctttccaaggcaattccattcaggacataggcatgggcaaagacttcatgacaaaaatgccaaaagcaattgcaacaaaagccaaaattgacaaatggggtctcattaagctaaagagcttctgctcagcaaaagaaactatcatcagagttcacaggcaacctacagaatgggagaaaatttttgaaatctagccatctgacaaaggtctgatatccaaaatttaaaaggaacttaaacatatttacaagaaaaaaacaaacaactccatcaaaactggataaagaatatgaacagacacactcaaaagaagacatttacatggtcaacaaacgtatgaaaaaaagctcaatatgactgatcatcagagaaatgcaaatcaaaaccacgatgagataccatctcatgccagtcagaattgattattaaaaatctagaaacaatagattctaatgaggctgtggagaaataggaatgcttttacactgttggtgagaatgtaaattagttcaaccattgtggaagacagtatggcaattcctcaaggatctagaaccagaaataacatttgttccagcaatcccattactgggtatatacccaaaggaatataaatcattcttctataaagattcatgcacacatgtttattgcagcactatttacaatatcaaagacatggaaccaacccaaatgtccatcaatgatagactggataaagaaaatgtggtacatatacaccatggaatactatgcagccatgaaaaggaatgagatcatgtcctttgcagggacatggatgaagctggaagccatcatcctcagcaaactaacacaggaacagcgaaccaaacaccgcatgttctcattcataagtgggagttaaacaatgagaacacaaggacacagggagggtaacaacacccaccagggattgttgggggtggggggtgaggggcaggaacttagaggacggatcaataggtgcagcaaaccaccatggcacacgtatacctatgtaacaaacctgcacgttctgcacatgtatcccattttttaaagaagatatattaaaaaggatagtatcatctgaaaaatttagttacaaaattcttgtagaaaatgtatatgtacacacacacataccccccatatatatatacaccacacagatattagcattatgataatttaatataaatcacagtatttaagaacaaatatgaatagtttagatatgaccctgggcaataggcattaggaattcaaggagagttcttcttctagtgtttctaaatcctttgtctaatgagtctaccaacagagccatttatttacagggaattaaatggaaactgctaaagcactcctgataatctccacctgctgtcctattattaaagagccttggagtacagtgaagtagacaaacacactcatcttacgtattttatttctagtataacctcatggactagtgatacgtttgcagtcatttaagaggctttatgtagcatgaaataccaaagaagagtgaaatctgaatcattataaaacaaaccacaatacagaggtgaaaagtaccatgagtcttagcagctttattgtaagagtccattcaaacattagcattttcacagtgccaggtgaatccatctgcaggatactgaagtatactgtctggtgcctgcagtttgagaactgctcattattaactgggtcatgattcaggacagcaccccagatgcaccacttccagcttgtgctaaaagacgactagcctcattaccatgcctgtctcctatgcacgctctcacttacttaccaagtcatcatttttaccatcatttccaaccatgtccatcatctgttgcctattttagaccttatttactttttaagtatactctagatgtccacttaatcagattctatgtgaatgtaaatgttaggggcagaaatgaaaggacattcatactaattaattcgcagcttagcactattcgtactgcgaggctttagaaagaatttctaggcatggcaaatcatatcttcctactcctcttcaagtgcaagaaaaatgcagctcctcctggagaacagtggcaaaaatgaaatgtttgtggagccaggctatgtcctttcttaaaaacaagttgactttaatttcgcctgggttggacatgctgattaacagaaacagtaacaagaccagggccttacaatgtttttcagaccctactatctgcagagggaagcaagaagaaccctttcttactaggctatcaaatagagattggctttgtgaaagttttcttttccagtccaggcagatgaatgagagtgaaaaatatgagggtgatgagaagtggtttgtctccccaaccctgataccctctagaaatctgcaaggtggacacttgtgttcaaatgtggttcattaacaaataaacttgtagtctaagaacattgctgtaactcacttctacttttctttacaagttaaggtgtggaaataccctggggctatcctgtttcattacttctctgaatccacagggaacttctccacttagaaatcaaatttttgaggccgggtgccgtggctcacgcctgtaatcccagcactttgggaggctgaggcgagcagatcacaaggtcaggagtccgagaccagcctgaccaacatggtgaaaccctttctctactaaaaatgcaaaaattagccaggcgtggtggtgtgtgcctataatcccaacttctcaggaggctgaggcaagaaaattgcttgaacctgggaggcggaggttgcagcaagctgagatagcatcactgcactccaggctgggcaacagagcaagactccatctcaaaaaaaaaaaaactaaaaaatcaaatttttggccagccacagtgactcatgcctgctattacagctctttggaaggttgaggtgggaggattgcttagggccaggagttcaagaccagcctgggcaacatagcaggacttcatctttactgaaaaatacaaaaagtagccaggcatggtggtatgtgtctgtactctcagctactctggaggctgaaacaggaagatcacttgagaggctgagtctgcagtgagccaagatggtgccactgaactccaatcttggcaacagagcaaggccttgtctcaaaaaccaaaccaaaacagaaaaaacaaagaaaggaaactgaatttttgtgatgacctctggtggaagaaaacttaataagcttttatcccaccttcaacatattccttaaaagacacatagttcattctttctggtagttctatttgttataatgttgtgtaatttatagctgaagaccatgtttacaaattttgtgtatcatcatacatatctcttatttctaaaataaattaaaagtcaaacgttactttgagggcatctcaaatttttgaggctaatcagtttggtaacttttggtaactgaggctaatctctattagaatgcttcacaagaaatcattaatctactttatctgatttttcttttaatataaagggaaaatggtctgatgatataaaaagatctgaaagcaatgtatgaaggggagggaagtatggtaaagtgctgaagaagtcagtgtctgggttcttacaggacaaaattcaaatctcatctctgccacttactagttatgtaaccgtgggcaagttcctcaaccttggtaattttctattgtttattctgatcgatggaaatacgaatagcacctcccttagagtccactgtgagattaacgaagtcatgcatttaaatcacttaccataatgcctagcacattgtaagaacacaatgaattacagtgatagcaatgtcaatatcaatatacttgtgttccttggttaaaagtctgataatgggcactatctctaaatcgcttctgtgttttccttgtagcatacaaagaaaaatacacttccagaagatctttctcacatacatatctgaagagtcatcgtatttaataacctccttcgttgtacacaccgaacggcatattctttgggtgataacagcttgctgtgtgggatttgggtctctttttgccttagatgttggtctgatactagccccaccccccaacagccgggctcctggcggaggtagtgggtggagctaacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 396 - DNA, 482516 bp, Homo sapiens; identical to SEQ ID NO: 395

SEQ ID NO: 397 - DNA, 304770 bp, Homo sapiens
aacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 398 - DNA, 26587 bp, Homo sapiens
aaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 399 - DNA, 26587 bp, Homo sapiens; identical to SEQ ID NO: 398

SEQ ID NO: 400 - DNA, 94886 bp, Homo sapiens
atggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 401 - DNA, 64741 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtaggggaggcgcgcggccccggccccgggcatctgggggtcccgggctgatttgagtccttcctctcccttccttcccggtcctatctcgcccgcgcctggagctcggcccggccgcgggggcatcgctggaaaagggcttcctcgctcacttttcccgtcttccaagggaccaaagagtgtggatgggagttgggggatggggagacgccggagcaggagaggagaggggccaggcctccaccccgtgattccactgtgctgctagcacctgagctaataacctcgaccccgcccccgggatgggggaactggcccggggtcacccctgcacttgggttgtctgacccgggcatgcaggggaccaccagctacggtctgggcggtgactctgctggggagtccactcagaggacccttgcctcctggacgatacctgtgcctgctctcctctccagctgcttcctctttctggggactgttagaaagttcttccttacactgtctgaaatcttcaggcgcctgctacctgtaggtgctggcttctccccggccctgcagtgttcccttccctgactcacacggaagcttcttctggagttgaagacagtgattggaaccccttctccctgagcccccatgtcttctggggtccagccccccagaacctaaataacagcaacttccctctggtccagtgcaggctggctggtctgggcagtgcccagggggaagccccagtccttggaaggctgggggctgggggtgtgggtgagcaggagacattggctttcttcctagctccttgtctgcccagacatctgtcgctttatcctgtcttcacaccctcctcagagcatggaagggagctttaaaacacccagaactcattctgggctgtcctgagggtaattggactttgtggaaggcggggcctctggggaggtgcctttcgcttttgtttggcatctggggacttttcaaacacttaatcctgtgtgtcctgttctcccaggaccacatttctgaccagggcaccaggacctctcaccgctctgccgtttacagcgaccatagcttgctagaatcttaccccatctccatttcctccatttcacagttgagaaaagtcaaggacccagagagtttatgatgggctaattgtcacacagtgaggcagggtagggctgagacccaattccggtctgccgtttgcggactccttgctgggagggactctagcctccttcttgggtgttccgtttactaaagggacaagcattccctgtacatacacacttgggggtgctggttggtgtttcttggggctgttaagggggagaggcttggaaacagaggaggaaggatgggggtgggaacggtcggctttcagctcctttgaaactccatttttctttctggggccatgctatttataaatgccagggaaattgtaaacagccaggggagcttgggttggcactcggtgagttacacagcagcaaagaaggtttctgtgtgaatcaggggaggaaagtttactccagaattttccacagtccttttattagggactaacatgagcctggaaacaggctgctcccaggaggggtggctgcagggtttgccccgcatggcatttccttcctccccgcctccctcctttcagcacttctctgggcctgtgttctgtgccttgccctgcgaggggccaaagagccttggaagaggacagagctctctgtcctcaagatgcttgccatctatactgtttgacacttttgtgccatattaagagtgacttcagcctgcaagaggagtgactaattttgtctaggtgagccagacctcagaatgaataatcatttaccaggagaaacaggagttgggggaaaagacattctgggaagcaggaaccactagtgcaaaggcactgagattttctgagccatccatgtggctagagtggaggatgggagaagggcggggtggtgggaggttgagaatctaaatgaaaatggaactagattataagctaagggtttggacctcatcctgaaggcaatgaagagctgagaaagggttttgacagagcagtgatttttaaaaactcgttattctgaatggctgatgtaggggatgcattgaacgaggctgatctggaggcaggaaggccctgaggaggctgttgcatgattcaagtgaagtagattgcaggtctgaactagagcagtggccactgggatgggtcagagcagcagattctggaagcccagctgaaggtctcagaacctgctataaatttcatctaaaagcagacaacaggctagacctactggagaaggttgctaaggtattcagcattgtaacttttttttctttttcatgagttttaaaacaaacaaaaattgttaaagaatccctccaagcccgcctctttccccagaggtcgccactgttaacaatggtgtgtgcactcctgccaaacacgttgattggatgccttcacttttagccatccagtgacagtgggtcactttcccctactccatgtgaatagtttgggtcatttgtgatgtgggtcatagagatgatttctgcttggtctatggtacgttgctgagacactgagctctggttttctttaagaaaacttttacatcctgtgtctgcggcctctgggtgtgtatatttgcttatcagagaccacaggtgtgagagaagttagaagcactgacttggaaatggacccccagtcttggttctttgggtgaccttgggcaaatcctatctctctgagcctctggttcctcatgtgtaaaatggagagatgttggtttgcatgataataataaaaagctatcttttaactgggcatggtggctcacacctgcagttccagcattttgggaggccgagttgggttgatggcttaagccaggagtttgagaccagcctggtcaacatggtgaaaccctgtctctactgaaaatacgtgctgggatgctcctgtaatcctagctacttgggaggctgaggtatgagaattgcttaaaccctggagacggaggttacagtaagctgaaatcacgccactgcactccagcctggatgacagaacaatactgtctcaaaacaaaaaaagaaaagacaaaaaaagctatcttttaatataccaagcactggaacattaattactttattgattccttgcaaccattcctctgaggtagatactagtatcttcttttacagatgaggaaactgagtccgaggctgaataacatgccccgggttgtgtggctattgggtgatggtgcaaggattccagaggtctgacgacagagccatagctattaatgacagcactaaacattctcttgaaaattctttctagtcctggtattaggagaactggtaagggagtttgttatgcttttatgaggggtgggtgtcggtgtgcagagcttggagagctcagccctgcagcagagaggcctggaggggcctcccggggctgtttgtaaactcatgctttcctgtgccatccgcaggaccctcagtgcaggtcaatctcccctccatttcagggaatccaggctccaaaaggacacaggacttgcccagcaaggtcatgtggtgaggtgagagcccagccaggactggtccccccttttcatcaatcaagcttatgctctggaaatctatctggcgaagccaggaaaactggacactctcctgctccttggttattccctgagaaaatgccagcagaagcagagaaaagcacgtcccaggggttatgcattttggggaggaagggaaaaaaagagaccagtgtttaggcagccgggggatgttaagtaaaaatatctcctcgctttcaacggagtgagcgtgtgtcatatttcagcctgatgtggtttgtgaagttggagaccacaggcaggctcagttcctgctgctggccagcttccccttccctctgtccctcccctgccatatgcctgctctcgtctgccctgcctgggaccacatcagcaatttaagaatagggcagagaaaagcagtgggtgttgtgggcaagggtaggcagctgaaggcctgggcttgggtcctggctttgccagtgacaaagtactgggtgacttgggctaatgcatgcctttctctgggccccagtgtccattctgcactgtagggtggacagcataatgtcagccttcccagctctgatggcctctgagttggagggctttgtgctccccacatgtacttgggtccggcatgtctgagacacaaagtgagcccgcagtggtgcaactggtgattcagctactgttcttgaatttaatcttttcggactgaattgattgccccattttgcagataagggagttgaggcctaggatttgttgatgtatcccattccctgctctacaagcaacaataataagggccaccatatgtaacacacttactatgtatgttcaccttttgctttcactatctgctttaatcttttaacagatctacgaggggagagatagtgactccattttacagatgaggaaactgaggctcagtttagaaaaatgaaaggacttacgttctcttctttgagtctcacaatagtcctggggttgtcattatgtgacccattttaccagtgaggaaactcaggcctggagacgtgagctcctttgcccaggggtccccagggcccacacacagcctgtcaggttccttcccaggccctcctgctcctccctcctcccttgcttgctctgcctcatggggagcctcttcacctcttgcattcagtgcctgggttaagggatgagaacagttttcttcctgggctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatgcactatttataaagagcctgattattcccaaatcaaccatttgcacacatctgtgtgttcatgtgttaggttttcttaatacaggctacccttgcactgttgtcagttgaagggaagaattccttgctttggtaagaagccctagcccctctcaaggacctattttcctcatctgtaaaatgggctacatccttagcatccgtgccagcctgtggtgaccagctgaggtggccccaaggggatgcatggctagagcccacgccaggtccctcctcagcctcctcacaaaggaccgaatgacttggctctgtgatcccatcccccagagactttggtgtgactgtggtgacccttggcatagcgcacccccccgactgcctcctcatctcaaaactttccaaaccatgacttttatagcagggctttaggaatcgcctggctctaccctctcacttcatggctacagatacttgtgccctgagagagcaagtgaatttcccaaagccaacagcaagccctctgattgctgctctaccaaaccaaaatgatttcagttctcatgaaacctaaggcctgactaaggaagattaagaaacctggtggtggtcgggtcctgtagtggggtgggaggaggggggagggatagtattaggagatatacctaatgtaaatgacgagttaatgagtgcagcacaccaacatggcacatgtatacatatgtaacaaacctgcaggttgtgcacatgtaccctagaacttaaagtataataaaaaaaaaagaaagaaagaaacctggtggtggtcatacgcctagtttgtcttggttgtgtggtcttgggtaagtcatttctctctctaacctattccctgcccccacccctccataatatggggaatacacattttcctgttcccctaggtctcctttctacctggttaaggttttattttaagatccagtggtagatcttggtctgtcaattggtcctagagtggaatgctttatgaaatcactggtacatgtgttaggtcagagacttaataccatgacatcatgaaagatgtctttagaccctttctctcctcattgctaacaaagattttatgaactgtgtttcagctggacaaaaaagatgttctagagcattctaagatcgcctggggcttttgttaaaatgcagattctggttccacaagtctggggtggggcctgaggctctgcatttctagtgatgctgatgtagctggtccagggatcacactttcagttgcaagatttgaaaacaatctgttattagtgtagaatcaatacttatgagataagggacttaagaggcaagtcccttgttcagggctaaagacccagtgacagtaatagggtctagcctggagcccagatcttttaatgtcttgtctttgacatctgacttatctgtctattttatctgcagctatgagtttctagaatctgaacagcccttaaaatactttgctgcttaattatgtagcaaagtaggttcttctttaggaaagagagtgactcagtagaaagccattggaagggggagaaatacagctagcatttgatcaaccctttcaccagaagtttttatacttgagattataaacattctttctgtatttatggatgcaaactacagtcctggggaggccccagtctgtttttgtatgcctctgagctaagaatggttttatagttttaaagtgttgttaaaaaacaacaataacaaacaaacaaggaagaatatgcaacagagagggtgtgtagcctatggagcctaaaatatttacggtctggcccttttacagaaaaagtttgctgacccatgatctagagtacccaaagatttgcatgttcttttttttttttttctagtcagcaagaggcccagccttatagctttgaaatatagtgaggtcaagacgtaggggaggcagcctgcgttggtgggaactgcccagacatcttagctgtgtgaccctgagcacattacttcacctctctgagcttgtgtcctagcttcacaaaatgaggacaaagattgctgcctggtagagttattgcaatgatgagacatgcctgtagagtttaacgcttggaaggtgcacagaaaatgataactattgttattaggggtggccatttgaacgcttatggcattaatggacagatatcatgttactcccatcaggtctgaaggccctcccaatgaactgggagcagtcttttaggagagaaaaatactctgctccagtatccccccatcccacctccagagcagaaagctcctttttagccagctagacagacagggttccatggtggcttgcagactttcatcgggcgagctctctccccaaagactggcctttccacagctgagactattagaaggcgtcttctgttcctatgtcctaggatgtgattcagcaaacaggcacgtagtgagagccccaggctgggattgtgagtgctggaatgaaacccttctctttatggctccatctggagtgtgtgggtggtggactagaatcagtggttttgctgaccttgtttttaagctgctgcagccttaaggtccaaaatggaaaacagaccaacttggagttagctggggctaattctaaacctggctgagtttgaaaactcagctcctggggtgtgtctgaatctcagggagagtgtaatgcttttcttgcccatagatggcagcatctgcactctttgccggctctgtgaatgtgtgtgtgcacgtgcacgtatgtgttacacacgtgtgcacgcatgggagtcatagtttcttactttggtaaatcttgagctgcggtggtcccagccctaggccaggctctgggatacatgggagcaattggggaggctgacttgcaaatagactattacagtagagtgtgaccgggcagattagggggtgtggaggtctgtacggagactacacggaggactcaggaacagagtgccattgcatctggctggagcctggtggggtatagtggaagacaggaagccatgagggccaaggctcaaggagttgaaggggacaggtcatgaagaatgtggagagatttgttaaggatcttggactttatctggggccatagtggagccatggtaggtctgggcagaggagtggcatggtctgggcttgctctaaggaggatgcattgtaggagggagaggttgcaggaggatcagttaggaaggttctgcagtcatgcaggcaagaggtgatggggctatggacccagatgttggcattggggtggggagaaggggggacactctggatgcagtcaggggttgaactagcaagacatggtgatacactggaggggagagtgacagagcaaaaggggtgagtggtgtgttgaggagggtgagggcctggtgtctggactggtccaccgggtggatggtggatggtggatggtagtgctgtttgccgagatgaggtgcagtaggggaggagcacattgtacttgggaacaaatgcagcaccaccatgtgcatctgaggatgagagtgcaatttggggtgtgtagaaagaaggggggctggattcgaaaggctcatcctcacacagagttgacagagtgcgggaggtcattagtcatttgcagaaacaacagaacccaactctgctttggtctgtcccttggaaccaggaagtttctgccatagtctttgagaaagacccacagaggtgggcaccaggtcctgcagcccagataagtgtctggcctctgacctctctggttttgggtaccgtgactccacttccgtggctgtgtcccgtgtcagtcacaatgcacaagtcatcaggactgtctgaaccatttactgtcagcctgagaacagggcttgtttgtgtcttaatcccaggagcctgcacggccctgccatcttcgggatcttggactctcccctcggcttagggaagctggtttaggcagagaaattttccagtgtgggcaggagccagtttgctcagcttccctctgaatgtagatgactggaattcttagtggcgaagaacggtgaagatccaagttgtccctgagaggcgggaggactgagctgcatactccacgatgagctgatgtgggatggtccttcatccactcatctagcatatgtccactggcactgccatttgcagggcacatgccatgctgaagctttagaggtgaagcagacagaatccttgcctccaaggagcttacagcctagagggagagaaagtcctatcaccagacactgataatgcagtcttgctcagcagtagtgcattagaacaataatagactgatgctgaggtacagagctgcgaatatgacatatcaacagggtgggtccccaaatcgcacatgtgcaggatgagaaagatacaatttgcaggcaaaagacttagaaatttaattattaataatcagggtaataattagagtaaacacatgccttgtgcaaaaccctgaacatgttttatctcatggtaggttctaatattatccctctttgaacagcaaaggcaactgagactccgagaagtgatgtagcttgctcaagttacacagttaagtgagggcccagtttatataacttcagagtactaacgtacagctctgaagttgactgtaaactgaattcagccatgcaatagggctgccttaaatgcaaatgggattttaggctcaattaatagaagcatgatatctctaatgaaggaggtgagagtcctgcttgccctgtcctggatagagcttgactgattgtctaattctgggtcttgtgctgtcagtagggacaggtttcatctggagcagatcagggaacagggtgagcgaaccggaaaccctggtctcaggaagagctggaggaaagggggtgcacaatttgtagaagacttgaggggcccaggatcactgtcttcaaatctccaaagagccatcaggaaagagggggacagacctgttctggctgacccaaaaggaggcagagctaataccagcaggtacaaggcataagaagagagagattttagtgcatccttaggacaattcttttacgcagccaaaccctccagcagcaggtcttgcagccttggcaggtagtgagtgcggtgttgctggatgtgtgcaagtactgattgtgtgacccctggtggaggggaggaaaggggttgaaacatcaaatggggatttgaccagatgaccttgaactccccctgaggctgacattctgtgccctttgtttacaggtagtgctcatagctctctttgtccagtgcttcggccttggtcccagcgccttcccacggagcagcactcttcaccctgcacagccttgttaggtaggtagagcaatacagacacctgtcgtcctcttaaaccccgccctggctgcccagggaagcctggaggggacttcagtggtggaagcagccgctgtagccacagtggattcagtgggagtccctgaggtcttcctaataaggctcagagtgcgtctctgctcctttcctgtccttgagagggaggtcaggcgagagtgatcttgtagggaggaggccgggactgggctcggtgcccggatgcctggctcccaccctggctgtgctggttgcttgctatgtgactttaggagagttgctttccctctcaaggccttggttgctattctgtagaagagcagagtccccataaagaggaggtgcaggaattcttcccagaggctttggagaggtgagaaaaatgggggtccatttgccaagtctctggacttgttgaccagaggaggagcacctgaggtgtgtgagtcatggggaagcggatgagtcatgcccgctggggccagctggcagggtggggcccacctgactatcagattcacaggtgacctgctgaagtaggtggggaggtggggggaggagtgcagagtcctgggctggaagccaggagactggctcacctcccagcttcagcctcggtttctccacctgtaggatgggtgccttggtctccccctacccacctaacaaagctgctgtgtggacccaacgagcttgtagatgccaaagggctttgtgaccagtgagacaggaaggatcactactagggggaatcgcccagcttccaacacccaaacagaagtgaatttctaatgagcaattgtgcaagaacccaggaaaacacccctccaacccacgccatcccttttctgccaaaaggagaaggggatgaatgaatacaggacttacgcgtctgctgtggcccagctggcttccagatggtgacatgagccacccacagccggagctgttcctctttcccaaagctcaggtgaaagggctttttggtggtccccaggatgttgtgccccaaaagccagggattcccaaaaggtctgccgggcccagaaagctgactcaccccatcagcggctatccaaaggttctgctgacaaagaggtagccctagtgctgccctaataggaggacttgagggccgggtcttggctctgatgcatctgcctttgagactgagccctgataactccaaaagccaagttgcctcaatgtaatctgtcaacaaaaagaatgttatgctctgttgatgcttttggtgactatgacacaggggccctgtcttccgcagaccctgcagggccaggctggcatagacccagctgagcaaccgtcgcctgagagctttgcttattcatccctctttactcctctgccccctgcaatgtaccagccctgtgcccacctccacggaaccttggttcaatcagggaggccccagtgacctcctcgatgtccaatccagtgctctttcctcaggactccatgtgccagtctctagtgcagttccagaaactccctccttttgcttctgggaggctgcactgtctggtttatttcctcttctctttttagttagggccctgtttttcctcctgacttttttagttagggccctggttttttcagttagggcccctcctctctttttagttagggccctgtttttcctcctgtcttttttagttagggccctggttttctttttctttctttctttctttttctttttttttttttttagacggagtcttgctgtggtgcccaggctggagtgcagtggcacgatctcagctcactgcaacctcctcctcccaggtacaagtgattctcctgcctcagcctcttgagtagctgggactacaggcatgtgccaccatacccggctaatgtttgtgtttttagtagagacagggttttaccatgttggccaggctggtctcaaagtcctgacctcaagtgatctgcctgccttggcctcccaaagtgctgggattacaggtgtgagccatgacgcctggcccagggccctgcttttcctgcctcagtgttccctaggattctgcccaccttcttgtcttgatttatgtatataggttcattcattcattcattcattcattcattcattcatatattcattcatttgagagatatttaggctctgagctgggtgttgaagaatcagcaaaaaacaagactttcccattcctcataggtcttcagtagatcattatttacactgaagattaattcttgctgtgaaggaaacgatcaggttatgggagcgtttgggattgggtgggagtggtgaggtcttatctggacagatcagggaagcctcccctaaaaagtgagacctgaagagggagagggaggtggctgagtgagcagggaatggaggagccccctaggcagagaggcgacctgggtaaggctttagtgagggggagtccttgaggaactgaaagaagtgagggaggctggccagggaggggggcgtggcaagaggagggcctgggggccaggcagcacctaggttatgtgggcccttgagtttggattttatgctagacctctgggaaccattggaagttttaaagcaggagggtgacttgcccagatttcattatcagaacccttgaaagggacagacacaaggaccatcctgataagccatgagggtgcaatttttggttcttccacatcagggtatcctgatgctgtgccttggtacggggcttgtcattgggcagtcctgggaaatgtgcactttcccaggattctctcagctctttgcattttttagtttacccggccagtccttgctaagctgctgcagtggagagggaggtgaagcagacaccaccgggccctctgagatccactctaatccaagacggagacagtggaagttaacgcccagagtgctctgtgataagtgccaaggggctcagggagacaaagagtgcttttccttacttgagagtcaaagaaggctgagaagggggagttgggcattccaggcaagaaggcaccgtaggcacaggcttggccgctggaagagcccactgcgcctgggggctagtgagcaggagtgtgagggttgaggtggggagctggttagagaggttttgaatgctgggtttctatcctctgggtaccagggagccatggacaggtcctcagctgaggagtgacttgatccatgggatttcagaacaattagtccatggcaggcagagcggagggtggatcagaggacagcagcactgggagctggttggagagaatgagtaccattgctgaagccttgtcactccccccaccgcacacacacagcaacatcctcaacgcccctttctgttccatacctctgttcggttatccccgaattggccggccagcctgagctgtccagagccctttcacagcagcactggggtgtgttaaaccctgggctccagaggcaaacaggtctgggcctgaaacatcaccgtagccctgacttgctctgtgcccttggacaagtcccttactcttctcagcctcagtttccacatctgtgaaatgggggtgataatggagttggtgatgattaaacaatggggaaatcaagtccttagcacatgtctggtgtataacgatggctgtgttagctttgtgtccttgttgattgtaatggcccagtccatgttgtaatctgcccctcagggagttcttgtctttggacataaatctgaattctcaactagaaacaagatgtccccagcagccccaaaggaagcctctagtgggacactgaggggattggacatgctgttacccactgggacccggcacagggctgggcacacagaagcctggactgggttttatttgttcctttatccccagcactcagcacaaggctggtacagcatggccaggtggctgggttctcaaaaatactaaacaaaaaaatgaaattaaaaaaaaattattaatcttggacatcatcccccagcacctttattttacagctgaggaatctggggcccagagaggaacagtggctcatccaaggccactcagctcctcagtggcaggccctgaacctgttcatttctccctgctcacatgtttattacaattctaatttttgaaatcctggtaagttaaaaatggcatcatgtcccacctccctaatttacctttggggaaactggggcccagagaatggtagtgactccttcaggtcctcagagagggagaagcaggaaaagggcctcctctccacaaagcatacccccactaatcagcagtaggcaggcaggttcttccccccaaaattgacggccttgtgcttaaggaagcaaagtggagtgtgaacaatagtttcctgaggaagtgttgggttttaattgtgttgaggagaagaaccatttccggaactgtgtgtgcctgtgatgcctgcggagttggcttggcacagctatttccagactaatcctgagtcctatttataggctgagatgattaggttggcctgtgtcaggagaggcccacatagctccccccagcctcgcgatggccgaggaagaagccctcaggggcaattctgacccatgggtgagtagcacgggatctggggtggtccccgaagccagctcagaggagggacgccagggagacccgagggaaagtcccgctcctgactcctagttcaacaccagccaggccccctgcagagatgaaaccagttccaattctattctctccctgcttaaaaatcctcagtgtgtccggtcaggccaggactccgtagcagtcagaccccttctccccgaggtatccactgtctcaaccccagccatgcttctccaaactgtttacgcttccttgtgcaggccacacccccaagcctttgcgtctgttgttcccaccttcccaaaagggaaactccatttatcctccaaggctctgccccaatgcccctcctccgtggctctgttgggccatgggtgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacagtaggtattttttaaaggtgtgtagaagtgagagtcagacttcggacttcagagtcagacagccctgaattcctaatggtgtaaccttgggctgaacctctctgagcttttgttcctccgtctataaaaggagacaatgccagccatgggttttggggaggattcaacaagacaatgcttataaagtacttatcatcacaatgggcttctatgagcataggaggtgttatttgcagatggggacgttcattccggggacgtccctatctagggccccacacaagggagtggctgagactccaagtcttggagcctccgactccaccctgtgttctccctcccctccctctcttggccccctgggcctattctcttccccagatcagggaaagctttgtttggcgattgtttttcctaagaagtttcctctgtggggcctctgggtgactcagccctgagtcaccgggaggctgaggacagggggaggagtgggagggaggcggagggaatggagagacgagaagaggaaagggctctaattctagccctggctctcccactgtttgatcaactaggtctgaccaggcccctctcctgcctagcctcagtttccccaaatgtgaaaggaagatgtgggcccagtcctggctgagcctcagaatcagaggttcccgggccccaccctagacctacagactcagaggctaggggtggggcctgggaatctattgtttcctgagctccttgggtgatcctgctgcacacctggtccacagaggtgttagggaactgctcggctcaaactggctcccagctgggcctcagagcagctcggcctctgattgaacttcactgacccacagggagcgcccttctcttgcagaatgctttggcagaatagtacacaggaagcgtgtgggctttttttttcttttttttttaaaaacagctttattgaaatataatttacatgatttattggagtaaatttacatataatttacatacacataattcactcaattcaataatgtttagtacatttacagagttatgcaaccatcatcacaatccagttgagaagattttcatcatccccaaaaggatccctcatgcttgcttacgtccatctctatgcacaccccatagctgaccacgcatctgctttctgtctctttgttgttttattgttgtattttttgtcacccaggctggagtgcagtggcgtgatctctgctcactgcagcctcaacttcctgggctcaagcgatcctcccacctcagcctcccgagtaggtgggaccacaggcacacaccatcatgcctggctaatttttgtattttttgtagagatggggacttgtggtgatgcccaggctgatcttgaactcctgaactcaatggattcctcccgcctcagccttccaaagtgctgggattataggcatgagccacctcacctggcctgctttctgtctctccgaagatccagagctgtgttcattccagctggccctgtgacctcatgcaaattattgcccttccattactcctctgtatgagagggaataatcctaccctccttgtagggggttgtttgaatttcactaatgtgcacagtgtctgacgcacccgaggagctgggcacgtgggaggctggtacgcagggcacaggacataacacagatgcccaggtacggttggcacaggcctagcaaacattttaaagcactcactctgtgccagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagacatggtacttaggatttgagacttgagctatggcaactgggcaggctcttggccacagtgggaccctttgtcatcagggatcctccattatgttggtgcctggggccccagcaagcaacagcaggaaccaagttcctcctcctcacaaaggcagtctgttttttttttcttttttttctttttttctccctcctcctccctgtctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgtgcggaagaggaggccgtggattgcaggctaacatttcttgagcctcttggcacctggcactcactacctcatcttgtctcatttgcataaagccccagtagcccggtgaggagacaggcccagagaggcaaagaacttgcctaaggtcacacagggaggcagagccaaggctagaccttggtctcccggaggcaggcaggtgaggttgtatagaggtgatggcacaggggatgttgttggggggttagtgggcaatgagactgcaagggcttgtgggccccatatcacagaggaccgaactcaggagtcctgacttctttctgtctgcaccgaggtctgcagaagggatgatgcaatctgtatgagtgacaggcccagtgcagagagagtttaagggagtgagggagctgatgttatgatcccagggaaaagatggggacaccaaaccaggacagtggctggagtgtgggggtgagaagtgggtataaagtggagaggagatgagcttggtctctgctctggtctcagcctttatgtactgtcttggtgggatgaccgtggttgggtcctgcctccaagggtatcccagagggttctagaaactcccacatggacaggcacttgaaggatagtgctggtgattgggcaggtgcctggatggaggtgaggcctaaagcacacccggggacagaaggcagcacccacacgggagcccagcttcgtgccagggactgtattttaggtgctggatcttgtttaaatcttccggctggctatgattatcctctaagctggggaaggaagaaaagcattccagtactatacctctgtttgggttaaaggaggggaaagtattttaaataaaacctattagagttaaaaggatgagtagcaataaaaatatctttgaatctctgatggttctattgtagtcaaaagttttagataaattgtgaagaatctctaatcatgctatgtggagtttttctcttttaaaaaatacaagttattgtatatacttaaggtatataacgcgatgttatgaatacatttagatagtaaaaaggttactatagtgcagcaaatgaacatattcatcatctcagctggcacaaaagtaattgcaatttttgccattactttcaatgacgaaaactgcaatacttttgcactgcactaataaaatctgctcatttagcatgaatcccaaaatacagtacaacttattccctatagtcctcatgttgcacattagtgctcttttttatttttaaatttttatttttgttatttttaatatagagagagacagggtctcacgacattgtccaggttggtcttgaactctggggctcaagtgatcctccctcctcagcctcccaaagtgctgggattacaggcacaagctctctacacttgttcattccacgtatctgctaccttgcaccctccatatcctcattcgtggattcaaccaaccacagatcagaaatattaaaaaaaaataaaaattaaaaaaagtaaaaataatacaaattttaaaaacagtgcagtgtaacaactatttacatagtttattgttacatagaaatttacatttacatttttatgtaacaactacagtataacaactatgtaaatagcatttacattgtattaggttttataagtaatctagagagatttaaagtttaatacatgggagaatatatgtaggttgtatgcaaatactgtactatgccattttatatattggtgtacagcatctgcagattttggtatctgagggaggtcctggaaccaactgatcccgcgtggatagggagggacaactattctctgatatgtctccccactggacttttttttttttttttttttgagttggagtcttgctctgtcacccaggctggagtgcagtggcgcgatctcggctcaccgcaacctccatctcgtgggttcaagccattctcctgtctcagcctcctgagtagctgggaccacagatgcccaccaccatgcccggctaattttttgtatttttagtagagatggggtttcaccatgttagccaggctggtctcgaactcctggcctcaagtgatccacctgcctccgtctcccaaagtgctggaattacaggtgtgagccactgcacctggcccccattggactttttctctaactgatttgtacttgtatcaagttctggtgagtccgtgagataatatggccattctatccctgtggacactgaagctcagagaggttgtgtcccttgctcagcatcactcagttgtaagtgctaggactgggatccagagccctcacttttttgtttttggttttttgcttttttgagtcagggtttcactctgtcacccaggctggagtgcagtggcacaatcataacttactgtagcctcgacttcccaggctcaagtgatcctcccacctcagcctccccagtagctagaactactggtgcatgtcatcacgcctggctaattttttaattttgtgtagagacagggtctcactctgtttcccaggctgttctcaaactactgggtttaagctatcctcctgccttgggctcccaaagtgctgggattacaggcatgaaccaccatgcccagccaagagcccttgttcttttgggtgaggcagaacaggcaaagtcagagaggaggggagggggtgtcattaggagtctcatggaggggattgggtagcaaggctggctctgtaggtgttggcttgaggccctctcctgagatgcatccccatccctggtaccagccttgtttggaaccctccctgtctcccttgctttgtatgcaaagacacagaggtagagggctaggtatgaggtaggtatagggcaggtataggggccagtgagctgtatgtgtgtatagggtctggacacatgctgtaggtcatctttggatgttatgcttactgagcacctgctgtgtgccaaacacagtgccagggctccttcagtcctaccagacaccccaccaggttggcatcttcacctcattttacagaggaggaaattgaagtgccgcagaaggtgccactggctcaagttccctggtggtagggatttgggctctgtccagattcatccctgtacattgcctcatattccttaggttggaaggtcacttgtcctcaccctgttggtcatttttggtatctccagcccacagagactccgcaggcactcctggatcccattgtcttttccctcttccccgcacctgcccccttttgtctttctcagggagttctccctgcagagtgcctttgcggggcatggtccacggatccctcacatttatggtctcatttaatcgtctcaactagccttcaagaaaggcactttgaccccgattttccacatccagacaatgggctcacacttcctgccagagcccagcaaggaggaaatcttggccatagttggtatgggaggcttggggacacagaagggctttgtttgaagccagcagcaggagggatgtggcaccatcatctgatgtgctgcatcattcattgtccccatcgggaaggtggttggcctggggaagcttccagcattcctggtagatcccagtgaaggatgaatctgatccctaggcaggcaggaggggaccctggccagatgcacaaacttgtttgctttttgctgtgtgtcttttagcatccttgagtcccagggcctgaagggttcttggacatgggccgattttcctgtcacctatgtcccctcaacctcatcaccactgggcagctcattatctctctggaaaaggggaaggaaaccagcatttgtctttccatttttttttttttaaactgtggaaacatacacacatcataaaatttgccatttaataggccgggcgcggtggttcacacctgtaatcctagcactctgggaggccgaggagggcagatcacttgaggttaggagttcgagaccagcctggccaacgtggtaaaaccccgtctctactaaaaatacaaaaattagccagaaatcacttgaacctgggaggcggaggtggcagtgagccgagatcacgccgctgcactccagcctgggtgacagagcgagaccccatctcaaaaaaaaaaaaaaaaaagaaaggcatttttaaccctatcttacatgtaaggaaattgaggctcagagagatagaaacttatccaagtctctcttttaacaataaaagcagcctcctttatatgtgcttattctgtaccaagcactgtgctaagccccaaatgttctttaccttattaaattcacacaactaccctaggaaaaaagtattataatccccgttttatagatgaggaaacggaggctcagagagccaaaacaacttgctcaaagccacactgctaataagtgatagaccggggacttaaatgcaggcatttctggtgggagctctttccacgatcacataacagaaggttgctctctgtttttctccctcttggaaagtccttcctctgcagagcaggaagctgcctcctgtggcttctcctgctcattctggcttgggttggggcattgtagaccctgccttcccctgcagctctgcagagcctgtgactctccaaagtcttctgctggttccacggtcccagcatctgcagccaggcctccctgtcttgttgtggatttgcgtttgtgcctgggcttcccaggggtgggtggtggggtgctgaaggggctaggacagttatttgcagccctggctactgacccaccacacctctcagggccatttcctccccgagagaaggggagacagactgctgaagtgggtcctagcaagaagggcccagagctcatacccatggccaaatctggctgcttccaggacatggggtcaggaagtagcagggccaggcccctccagatgtccagccctgggtcccagcactaggtggggctggctccggaagctgggaaaggaccatggctttggtccctgagacagttggtctcctggagttggcttcagccaagccccgctggccatctccccaacagctggccactcccaggatggacttggccaaagcagaaggccagccagccccgatggggagcactgctgtgtcatggagacccaggcctcagttctggcctggttgttgagagacctgagttctagatctactctgccaggcacttgtttgactttgtgaccctgaaaagtcaccctcttgttcttggtgtgatcatctacaaaagagaagacagactaatgaacactgctgctaataagtcctgctctgaacaacatactccaacagtctcacttctgttcccccaaaagtcctgcaactgggcatcactgtccctgtttacagatgagtgacctgaggctcagagagggaaggtaacttgctctgccttacacagcccagacctgaactctagcgtctcaccgtgaaatctgtaacgtttctcccgcaccatcacataccgaaggcaggcgtctgtgcagaaaacaggctgctcagaaagaagagtgcttacttttggcgagctcctgtgcgtcacatcctgggcttcctcactgctccatgctctaggtaccattctcccccttttagagatgaggaaactgaggtctggattgcagaagctgagtccagattcgcaaacctgtccacagggcttgccggaacttttccaggccctgttcagttccactgggtttcataactggcttctctgtttactgaccattgtcccaattagcaaaatccctggtcagaagggcgggtgctcctaggaggacccagagaacagcagtgagccaaaaagtaaatagactccaagagagggctttccatgagtggctggctgcctggaaaatcaagaacaacagtgtttggagtgaagagaaaagaacagggtggtgtcttccaggcccagccaaggcctttttgtacactgtggctggggatggaaggggcgggggaggccacctcctctggtctctggtagggggtcccgcagacatacagagaccaaggttacagaggaaaggagggcccagagctggttgtgttgtggaggtcctgggtcaactacaggggagggaggggtcccccagggggacatgggctgtacagcccccatcctgtggcagacacagagaatctgcctactgtgtgcctggagctgggcaggatccaggaatagccgagatcagaggtcaaggagatctccgaggtgcacagaagcagagaccaggacatgctcatgtactgagttggtagcagaagggctgcctccaaatcaaagaaaccatgccagacctgagtgccatgtggctcagagggcaggtgccacagccagtcctgcactaaatggccacagcctggggatcttccaggcctttggcctgggcagtcacatcaggtgtgtgaaaggctagagggctttcccggtgtcacctcctgccctggcctgggaagtgtcgtggggacagctgctccggagactcctggctgccaggcttgacttgggcttgattgatttagcctgttacctggaaagggcactgctgctccctgcccaggtcaggtggtgctaggagctcctgcttggtctccgcagacagagcctgggctctgaagccagtcagacttgtgtttgaatcttggcaacacctctttccagttgagtgacttgaacctccctgagtctcagtttcccaggctgggcccagaggtgaggtggcatgctgctatcagtgactgcagtgcctccttcctcaagtcaggggctgtggactgtctgatccagaacggcctgcagaggtgacctggccgaatgtacccattttacagatggaaccctgaagctcagagacttgtaggtcctggatttggttgtacaaccagtatctggtactgcttgggctaggaaagaggcttcgagtcagagcatcaggccctaccctgtattttgcatatgaagacactgaaacccagaaaggtacagtgacttgcccaaggtcaccaggaagtcagtgtcagagccagccctagcactcgggcctcttcctttccacctaggggtccttctcttgtacctgaattcccccattcccttgaactcatacatcttcttccaggctggaagcagagtaagacaatgttgcccgcatcatggtctccactcatcagtgccctgtagcaagggctccagggtctgtagtgagggctcccagagggcaagggtggggtctgttcaccagctctcctgtgccaagggcctgggctccagagctatatggcaggcaaagctgcaggccctttgtgatcattaacgtggtccctgggttgatggccagtggcctctggggccaaggtcaagccacagcagcccctctattaatcaccaactatgcaggtcagagtcacactgctctggaaggggcccctcagctgggcagttgctggcccaggttcagtctgggggctgggcagctaagaaaatttcttcctacttgtttgaattttccaaattgtctaatgagcaggcatcactataagcatattttaaaagggattgtttctggatttgtgttttataaaagaacaaaactatattggatatacacttgtaaagtttcaaatgctacggcaatgcttttacaattttttcggctagtatattaaggtataatttacatatcatagtgattcacacactaagtatacctatagttctatgaattttagtagatttaattggttatataatcttcaccataatctagtattagaatatttttatcaccccgaaaagttccctcatgccaactgcagtgatctaggcacttcctccagcctcaggcagccacggcaatgtttgaggatgaaattctcctccttcttccctttccagcaaacggccttaacagtttggtgcttaccctctgattttttaagggtatatgcaaaaacaggcaccattgtaaaaaggagaagaggagatatactatagccattgttgtgcaattgctttctgcacttggagatctccctgtgtttattgagtgcctactatatgccaggcacaatcagacgtagctcattcttttttcacagctgcatagtgtctattgtaatggtggctccatcatttatttaaccaggacttttgggtcctttccagttttcttcaaacaatgcttcagtgaacatccttgcacatatatttttgtgtttgttggtaagtaattctgtagaaagtggaactgttgttgcgttgtgtgttttgagtttggataaattttttatctagagaggtgaaactggtttatgcttccattaagagcctatgggagctgtggggttttttataatatcatcctccaaatggctagggggaagggagagctctctgaatttaggccagagctggcccactgcaggctgggcaggcccaggcctggacttggagcccggagaactcaggtatccctctggggccccccacagacaccgagacaaagttcagactcttcagtgtggcacacaggcctcggtgacccctgctgccctctgcagcctcctctgctcttgctccctgtgtttcatactggacccctggtaattcactggatatggttatgtttgcctgccctttgcctatgcgtcccctccccctggaatgtcttttcttcttaatctccgtcctccctgtccttcaaggcctgggtcacaagtccctttctccacgaagccttcttataatctctccagcctgaattgtcttctctgtgttcctttagtcttttatctgaaccatatccccccttaggtgggagcaagttgtgggtgggagagggcaaacttcagcctcattagatagaggctggacttccggaagagctgggaagggggaccatagtttctggggaggggtggagaactcacatttacctagctgctggccaggctattttcatacccacagaccgatttaattctcaactactgtactcatttagtagatgagaagaatgagacattgaaaacatgcacagtggaggtgggaatgaaagccagctctccaactctccagtcctctttcctgtcactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacctaaaatggaaaccaaacaaaacaacttcaggaagtaacaagggcttgcttagagacatgacggtaaaccctgaaccatcagctaaaagaggtagatagcagtggttgcccctggggagaggtaaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccggcagcaccatttacaagctgtgtgcaagttgcttcaccactctgcgctgttcccccctctgtaaaatgggttggccgttgtaccctctctgaaaaggatgtgctgatgcctcggtgaaaagctttcaaaaattgttagttcatgttatttttttgctggaggtgttaggtgcggagaggcgagggggctcgcgtgcgtcgcaggaggctcagctgggctcgccgccgctcgtgcctgcgcccatttagtgtgcacacagctagcgcccgccgtatgtcaggcctggtgctgggtctccgccccggagctggggtgcaggggctgccgcgccctgtcgggtcgatccgggtgggaacccagatgtctccaagatccgagacagatccccgccccgcgccctccctggggggcggtccccggcttgggcgggatgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 402 - DNA, 64741 bp, Homo sapiens; identical to SEQ ID NO: 401

SEQ ID NO: 403 - DNA, 64741 bp, Homo sapiens; identical to SEQ ID NO: 401

SEQ ID NO: 404 - DNA, 64741 bp, Homo sapiens; identical to SEQ ID NO: 401

SEQ ID NO: 405 - DNA, 64741 bp, Homo sapiens; identical to SEQ ID NO: 401

SEQ ID NO: 406 - DNA, 64741 bp, Homo sapiens; identical to SEQ ID NO: 401

SEQ ID NO: 407 - DNA, 64741 bp, Homo sapiens; identical to SEQ ID NO: 401

SEQ ID NO: 408 - DNA, 33042 bp, Homo sapiens
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 409 - DNA, 248545 bp, Homo sapiens
ttgcacaaatattactttcaattttatttaaatcaaataatgttgtgatgatatgaagaactttgcatagaaaccacatgaattttaaagacaaaattcgaatacctaattatcctattctgaaacaattaaaagaatacacatgttaaattgccataaacatgtacgtattacataatacacataacaatcataaaacattttatactgatttattataaataattggaaacaatatttcatttctcaaacccagacaacaaaacagtaaatatcatgctttctttttttattattttattttgtttttgtaatatgagtttggaaatagtattctttatccaaaaactggtttaagaaagtgtctgtaggaacacaaaaggacaaaatactcattttctttcccttaaatgaaaacagttgagaagtttttagaaggagaggcttacctgctatgaagaagccaccaagaatagaaaaatggtataatacctgcaaatatcacttgtaaggcaaaaaggggtagaatacagacacataaatataaaaaagacttgatggtaaactttaaaaagtatttttcttaacaatgtgaatagctttattttctcaaatggaggaaaccattaaggcatagtggatcaagtcaccaagtttgaaactggtattgctaccttgccaacaactgtctcttttatgagaggaggcccagtagctttatttcaattttctcatcccatagtgactcatgttttaataaaaactgtttactgtcataaccttggacacttacaggcagagaagacttcttgataaaataatgcagtaacttcaagcaccccaaaaattcacttaaaatacattatcccataggaatatttccattgagttatttatggcaactagcagtcagaatttcttagtcaggtgactatgattaattttctttttgtatatatttcccttacatataatagttttgccaatttttctcccctgataataatttttaaaaattaaaaattgcctaagggaatggactgaaggagaaatatatgaagaatgatgtatttcattaagggatatagtagatttctttgagcatttgtgttatttgcatcaattaaggacaatgttgcatattccagattaattagctattaggttttttgcagatataaacatgctatgtacaatgatatttataattattttattttttatagacttcaaagtgtttcttttatagacactggaacagtgtgaatctggtaagcatgtttcagttaattagcaaaatttaaattagcaagacataacagggtgagtattggagttctaaaaatatttttaaaataatgaagttacatgtatgtatacacatgcaagtagatactgtaaaatgaactgctccagagtacttgcttttacttcaacttaacatactccaaaatattgctttcctgtataatatcaaaggaaatattaaatgcatgtatattattttaagaacttgatgatatattttacattcttttaactttactcaggctataaatatatttatatatcattcaatcagtttttagagtaaatgaaaaccatagtatgggggtggtaagttttcaccacatacatccttacttgattatgttcatttctttttctgaaaactgtatcaaaaatcagagtaatggagtttgtttctaccacacacttattgtccatgtactacagttcattatggcttacaaaaatggaattttcatttgaagatgggtaagcagaaatcaactagtaagtatgatactggaattaggcttctgaaatccattaacatttaaccaactcagaggacaatgctgttctaaatttttatcaaaattgtgcaacagtataatttgttagtaggtttgcatagatataacaccttttcactggtataatacatcttttccaaaggattatggcaggcttgtttctattcttcatgtatattctctttttcactctttttttctgttttacatgaaattaaccatatttatcatctggctaccatagttccaaaataaggtccagtagtagtttgaagcacagcaagctcagcagtttcttccctttttaaagcccgacagtcagtggagttttctatagtcgagccacgtgagcactgtcaccccaagtagagactcttgtgaactcaaacggctccagattcacggtcaagaaccttggtgacttcacataactaccacttattgctggaagggagacaatattgtttgcttctgaagttttcaaacagtttctcacctggcagcttctccggatttctttgttgctttcataatcgcttctgacattgcgctttcaaaaatctaaaggtcgaatcatcatagttgtggaacgtaaggagtaactgggccctttgaagtagtgccactttatcccattcagttttccatggttttgtcccgcagtatagaacattccatttagattggaggggccacaagcatcaaaccaccatcctgaaaaaataattcataatagaagagagaaggagaggcaacaattttaagtaaatggaatatttggaaattaatggcattaaatgatgggaaacttgcttgttcttgttatgcttatttgcaattacgaggcatcagtaaatatattcccagtagtgaaactgttttaaatgacttctgatttaagatttgtatgacccatcacagacagcaatgctctcatggaaagcagctttcagtgtgactccactggaactcacttcttcttgtaatgatgggaagcctctgggcttcaagatacaatctacataagagatggatttacatttaagacaaatgcaataaggaaaatgcatatacccataagaggcattccatcttaagactgttattgggaatagaacaattaattattagtgaagaaatgcagaaacttagacaagcaactgagatctaaatagaaagatattctccatctactgcatatgtttgtcaataattggccctaagctgcttctaaaattaattggatactgtgcaatgactatgatgctcaaaagggcttttaattaacgtaccctctctgtagtttataacagtagaaaaagtgttcagcaatagtagccattcagttcctgtacagccatattttgtctatggttatttaagtgctttccaaacttagtaaaaagaaaaacaacttgatgagtaacatggaaattctatgcttgtatagctctctataaggataactggataagtcagttttattttttaaataaattaagttcttagatttttagataaagcatagtgttttttcctgtctgctgaagtaacactactgaatctttagggagagatttatgccagagacattctggcatattttttatttggatacagttgacctctctttgattacagacttatacctaagggactaatagctaaagaaagagaaagctgtacagctgatgtttaactgtaacatgagcacaatcttgcagaaactttagaagaagtcaaatggagaaaagctagttctcatttttcaactttagaagatgagtacagctggcttgtgtttataaagtcacactagaggcgtaacaagctgcattaatcaccagttcatagtggggaaccacaaggtatgtcttgatgaatttggaaagacattatattccgtgcagttttatcaactgtatgcaaacaacataaatgttaatgtagtcaaaacatgagggacaaaaaggttcttgtttggaaaagaaggaggaactgcaagtaaaatcctacctttgtttttcttaagattaattcttctaatttttgatcagtacagctgttaaatatgctgtttatattataaaaagcattctaatattagtgaatttatttgcccaaaagactctttctaaaggactaaaataaaactctaagatgaaattcaacttgattgattctgtttttaacttttctcctccttttctgtgaccttcttgaagcacttttccattgcattaatgaacttttttatagtctttcaaatatgcaccatggtctctcaagcaaacacacttactctattgttgagactgacaatgattcatagaattctcttccaagttgcattggggtaaaatgtgtgtttttgtttatttggtttatagaaagtcacaggagtcccagaggagtgcggaaagacagacgtctgttgcaacaacagcctggcaataaagagcacaggctaaaggatacgctcattgggaaactttgggaaaacttaggaaagagacaagaaacagtaagagcctgtgagagagtcaggtaaattgatcttgtgtagctttttgaaggaataaagtggggtaatgtttgcaatgagtagaatggcattttggagacattgaaggaaggccagtatggctgggtcacaatcaacgagggggatagtcacctgaagctaagtgggtctgaagcaaatcacccagtgttttgttcatcatcctaaaaacaatggaaagccatggtttgtatattggcccatctcctgtacttagtaggacacctaacgaagtttgcttcccaaatgaccggcgggtcactgcaggcttgttaactgattgactctctgattggttctccttgtgaagtctttgttgtctgaagttgtttagcttactaaaatgctgtatttgatagataccccaaaatgtaacacctgtccttattgtattcatttttttctttatgtatccattcaatatataattattgtgaaacgttgttacacaatactcaagacagacatagtccttgccttcatgaaactcacttctaatgggagaaacagatgaatatatgtaagcaggcacataaaataactattaggttggtgcaaaagtaactgcggtttttgccatgactgttattgacaaaaaacgcaattacttttgcaccaacctaatataaattatgacttaaaatgtcatgaagaaaatacgtaggagctctgaaggagaataacttgacttttcacatttgtgaaagaagctgatatttaacgagaccagaaggaggagagagacagccccaagaagatgggaaaagaccctgctaagcagaatacagcacctgcaaaggcgatgaggaagaaaacaagcttgggatgtgtagggacatcagtgcaactggtgcacagtaaacaagaaatgacttgcaggaaatgaaggtggaggaataggcagtcctggtgagaagttcaatgtttatggaacaatttgtagtttagccagcctgcttgtccatgatcaggcaaacaagtaaaacattctctacagatgggaaccacaatcgaaccagaagaaccagatctgctaggttaaatgtttaatcaaacatggtttagagtcctcattctctacgatcttccaaagccatcctgagcatatgtgacagcttaaaaaaaaaaaggagaaaattgagtctagaatcaattctgcaaatattaaccaatggatagggataggggacagaaatttttggaaacaaaatttctgactttaaagcatgcacagttttgtgtaggagacaaacaaaatgctacacattgagatgatagccgttaaactaagagaagaagaaaatttgatggaaacacagaggcagtaggtgctaactgtctgagggaccacaaagctcactcattcaacagctgctctgggtcctgaaagatgggtatgagttcactggacagaaagagcttctatatagtctgtactctggaagaccaggggagagtgtctgccagcaggttggcttggctggagtgccagtgggttaaagggttggagaatatagggctaaaaaataaacaggagggaaaacataaaggtttttattacacctttagacattttcttttgggcaatgggaagcctggagagcgccggagcagaagttagaagacccagacttttcatgcttacttcatcaataaataaccaagagatcctacacaatagtaccaatagtatttgatatttattgaatcgttcatatgaaggtatttatatgcattttctcattttatcccccaaacagccttaagtgatgtggcaagtaccataataaagatactaatgctcacagagtttaaggaactgcttaaggtcacattcataatacatagattctaagagctaaccaaccattttcacagcacagttataagaatcaaataagataatgcactattacagcctgtaaaatcctactaaagtgccagctgtaagttatctagaaaatggggcagaatgtttaggccagaaaaaaaagagacaagaccttgtggagcatcacagtaatttaataataaagacaaggtcatcagtgccaacatattttcttatttgcttagtggggtttattagagaaatatgaaaataattagacccaaataagtacaactgtacaatgttcatgttataaaaacttggcatttaagttcctaatttttttaaatgtttcattttgatttcatgacaaatcaaggagtttgaaatgttcaattaactctttatcttaagactagtgggccatgaattctgtgatctatctcagagcaactgataataaagatgatgaattaagatggaagaaaatgaaataaaagagcaattatttctcatgacaatttcagttttattataaaatatcctaacttcaaggtagaagaagtaattacttctgtgtaggcaaggattctctgttttctttgatatatacattaaaacaaactaaataatttgttcgtatcaaatatttcaaacagtttgtccactttctacctttatttttaaaaattaagcatggccaagtcttttaaacacaaatcctgaaaatatgtggtttaaagcattttttcaatgcaggcaaaagtatagcagactcctcattactcatatgcattccttgtatttacaggtgatcatagatactcagtacatatggtaaatctgcatgggatgaagatgttctatgaatatacagaagagtatgcctgagtttacagttcctctctgataagattctgaatagctgaattatatattctgtgcaatcctgggaaaacactgactttgtattttgtttatgcttgggaataacaaataagaaatatcctagagcaattcatttagggaaggcacttcaagcctgaaagaactcaatgatgcaagcaaaggattgaaaaaaaagttaccctctgctattgggacaactgataaaatgtctcaaatgtttttttgttttgttttgttctgtttttttttttgttttgttttgttttttttgagatggagtctcactctgtcacccaggctggagtgcagtggcacaatcttggctcaccgcaacctccgcctctcgggttcaagccattctcctgcctcagcctcctgagtagctaggactacaggcatccgctaccacgcctggctaatttttgtattttttttagtagaggtggggttttgccatgttggccaggctggtctcgaactcctgacctcaggtgatcgaatcacctcggcctcccaaagtgctgagattacaggcgtgagccaccgcgctcagcctcaaatgtcttaaggttggcaactgctgagatgtactttcgaagcatttttcttcataacctgtaacctcatgtatattttaataagaaatctgagattcatgtttccaattcatttacacttaactcattaaaatttagtttagtaataactatcccaggccttttaaaatcatttgtgtcttttatctttgaagcagaaaattcacattttatcgctaatagatgaaactttgcccagaaaataggaatttgattctcaactttgtactcaggaagttcaactttatttgaacatcaggaaatctaactcttaaattcttctgattctaaacaaaacacctctcaacacttcttttctgtggtaaaatgtacagcaaaatgaaaaggtatatttgtttttgtagatttcttttgttcgttttcaatgcatgcattctaatcagcagtatgcaaaacagcttgcacagaaattaagattttcatctttcatcactaactaagaatgagtttaaactaaattgattggtgccatcaatgggatcataatggaaaaaatctcttggtgagtttatgtggacaaagttggccctacgcaaagcaagcctcaagaagcagctgcatgggtcttgcatgcaggaggcaaagaaccttgctagaagtccattccttctgtcatctcttaatatatcctcttcaggccaaggacttgtttttgtttcttttttgtttgtttgtttgtttgtttgtttttgactgttctttctttctctctctctctctctctctttctttctttcctttctttcctttcttctttctttcttttcctttctcttctttttgttctaaagatgaaaagttgtttatcctggctaggaatatcaaattcacttaaaacttctaggtattcttttacctcctctcttctccctcatacttcattttgcttttaaccatgtttaaatgaggaaatgcttgcaaaaagatgctgcaaacggtacaatagagctctgtcattctctttgaatgtcatcccttttaatggaggcagtagaaagagtagatagaacaaaggcctctggaggttgagtacctgcatttaaattctacttctgacaaaattctgtgacctatggcaaattatctaacttttctgtatctcagttcttgccaaaagtattattgtagtctgtatttccaagagtttttggaagcttcatatatgttattaaatataaatcatttagaataatataaacgtatccattagaaagagctcaataagtttttaaatattattactgagtacaatacaaaattaattggttatttctcatccactgtcaattattaagctttggttgtagccttgcacgagaggactatcggttctgattcacctttttccaaacttataaaagacattttctgatactctttgctctttttctaagaaatgaaactttgcccgagaaaataggaatgtaatcttaaactttgcattttaggaagctcaaatttatttgacagtcaggaacctaacactcaaatttttataattctgcagttcagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtattttcaccagaataatttgtaattttgcaatgtcctttcagagtctctgctaacatttactcactaaaccaatatttattgaacatatgctatctgccacacactatggcagccactggggatacagtagtggacagcataaaatccctgcattcacagaacttacatttgtgtagaataggcttacgttttatgtactaaatatagaaattgggttgaaataaaagtagtgcaatgtagatttctatagtcaatcttacattagtcatatggatcttcttttctctcaatatttttaccttgaaacagagaattttagttatctgatcatgcttagcaggtctttcttgggttcccaaaaatgctaagacaattatattttcccaaagatcttgtcacttcaaggtcatacaccagttgaaaaaactgctagcttctatcattttctttgtcttctttaagattatatagtaggcaaagtgagcgtttgtcaactgtctgctgttagcatctggaaagttctagatgtactaagaaatttacgtgtatggctttatcccctatttaaggactgaactgaaaaatatccttcgttagctttagaaagtcttgtctaccagttgacatggtttatgcattgggaaaagaaatgagagtttctacttcaatagattctttctacagaaagttaggtcacatttttacatagcctttatattatgtactaaatatggaaattatactgaaactaaagtaaggaatgtaaaacggtaacatatttgtttttgttgttggcaacctttaataattacagtttatgaaagatttttagaaataattctttaattataacattaataattttagttaactgtagcttaagcaaactttcagaaatgcagactttgaaaactcctaatttagtatcaaagatttttttttagctgaaggtaagtttgttttgaatgtgacaatctagtaacaaaaatttgtcactgtcttaattttggaatcagaatttttcacatatttatctccatatacaataaatctatacaaaaagtatgcattgaatgagatttcattttcattttcttaatgttaaatagtagataaaactatttcttttaaatttttaatgaaacttatgctctagcctgtcttgctcatttgtttaatagtaattaacccccttaaactgatagaagaaagccaagaaataaggaagttaggaaatgaagaacaaagatcaagtcctaccttgggtctagctgaaataccttctgctttcagttaagcctatttcctgccattcagtcttttaccgataagggtaatgataccagattctccagctagaattcctctatgtacttgaagaaaactaggatagttagtgggcaataaatcttattttactcttaatcccttttagaagaaacaaaggaaaaatatataaataaacaagataaaacaaagctttaattgatgatgacaaagagctatgagttactagctccaaagagtatgaagtctcactgcttaagagagggtattttaaataggcaacaggctcaaatactaagtttaaaaagaaaaaaaaggaaaggaaaaatcattagatgaggaaaatggctctaagggaaattttgacagagaataagtagtagtggtggggagtaactaagtaggacctaagttccaggcaatactccagttacctggactgtcaatgacattcatccttatgttctccagttcttagctatctaaattccacattttagctttccataataaatagctttgcaagacctggattctttcaaagggacatttgataaggtaatggcgtttattacaaaaacacatttacttagactattccagcccaagcaataagtggaaatattctctcccaaacatatgtgtttattggtgagtaagaattgggtccaagaataattatggatgaaagaacatgacgaagttcaatcatttaaagcagaaataaaatcataaatctgagcagtgaagttttctcattgaaaaccaagatgtacattcttctctttgcttcactccatattttcattattatgacagaaatatgaacatattggaatactcttctaaggacacatttgaaagattttactgttggttttttcatgtattgtatttatttggtaagaaaaaatatctttgaaaatagacatggagaaaataaagcatatttcaatattaaaatgtgcaggaaactgaaaaatcaaagtccctttgtctttgtataaagttgctgacaatttcatttatgagatcagggaagtaataaaaataaaaattttctatcaggaaaaagctcaagacctaccttgtgtgtaccatttaaaaaaaaatattagatttgtagcaactagttttgggggtgagggctgagggaggagtcataaaattacatataggagactttttaatatttgatgatgttaaatatgatgccaaaaggatagttcaaagattaaggaaaagaacatgaagccgggcacggtggctcacacctgtaatcccagcactttgggaggccgaggcggtcggatcatgaggtcaggagattcagaccatcctggctaacacagtgaaaccctgtctctagtaaaaatacaaaaaattagccgggcgtggtggcaggtgcctgcagtcccagcaacttgggaggctgaggcaggagaatggcaagaaccctggaagtggagcttgcagtgagccaagatcgtgtcactgcactccagcctgggtgacagagcaagactccatctaaaaaaaaaaaaagaaagaaagaaagaatatgatagaatatgatagaggcagaatcataataggttagttttgataatattggggctggtatcatattgaaaagatatcaacataggtggcatggatggggtcaatgggctgtgatttggtgataatagtaatagaggggttggggatagggaggaagacaaaagatttatcccaaaccagctgggtgtggtggctcatgcctgtaatcccagcactttgggaggctgaggtgggtggatgacctgaggtcagggcttcgagaccagcctggttgacatggtgaaaccctgtctctactaaaaatacaaaaattagccaggcatggtggcacgcacctgtagtcccagctactcaggaggctgaggcaagataatcacttgaaccagggaggcggaggttacagtgagcctagattgcgccattgcactccagcctgggcaacagagtgagacttggtctcaaaaaaatgataatcatcatcatccaaaactttcacctatactctaccaagctctattcgtggatgaagataacatcaacctaatgatttatttatttggttttaaaatttgaaagttatttcaagagttaaaagatggtaattcatgtactatgctcattcatgtacactactacttcactaattcaggtactacattttctaataagtttctatgtgtcacagtcagctgtgctagatgtttgggatgaaatggcaaatgctagctgtcattcattttcctcatgtacaacatagagatgagtttctctccctgctatctcacagagtggatctggagttcaagtaagatagtacaacatgtgcagaaacacgtaatatgttttaataatggtagtaacgtagtgttgggaaaggaaaatattagatttgaacaattttttccttgctaatatgaaatcatgttttgtaacagaataagacagaaagtatatcagaacaattgaaggtggtagtgattattacagtaagagagaagcagcactaaaactgtgagaggagaaacactgaaataggaatttctcttacaattttgtttgttgtcaactcctttcctgccagagcctataacattcttgagtgatatcatttgccattgggttttatcttagtgtttcccaaacttcagacagtcatgtatcaacttcacagttttgccatatccatttataactcttattaatatgtaacaattttttctttaaatctactatttgttaaatacagaatattgtgaatgcattctaaaatgcaagtttatatcattcatttaaagaggaaatcagcatcatttgctgtaacagaagttagatatagccaggtgccatggtggctcatgcctctaatcccagcactttgggagagcaaggtgggcggatcacttgaggtccggagttcaagaccagcctggccaacatggtgaaaccccgtctttactaaaaatagaaaaattagccgggcgtggtggtgggcacctgtaatcccaactactcgggaggctgaggcaggagaatcgcttgaacccaggaggtggaggctgcagtgagccgagacagcaccactgcactccagcctaggcaagaagagcaaaactcagtttcaaaaaaaaaaaaaaaaaaaaaaaaggaagtagataaaaaactcataaaattaaaacaaactaacattatttaattttaggtatgtgccattgcttaaccaaggctctgagactatggataagggttttttgttgttgttattgttgttgttttttgttgtttgtttgttttgccaagaagcatcattggtaagtgatgcattacatcactgaagaagtattacagaaatgagagcaccaaattgagaatttctctgtggggctatcagaaggctggaaaaatatttaaaatgtacaaaaggattaactttcttactctatgatatgatactatttaatggtatctcctatactagctaaaatatcttgcaatgattaatattatgtaatgcaaaactctggtatagctggtctgaactgtgttacctttggtttaactacacctctttatttttcttatctcatttcaacaaaatgatcaattaacttactacataattgcgaagtattttataagaagtaattgctgtatatgctgagttcccaaactattgttcattttactaaggatatcaagatactaatttagaaagtagaatatctgggacttaagagactgaaaaatgtattcagaaccaagcttagcacattttcactcttgatgttgggggaggacgcaaacctctaaatatgctagcaatgtcttacacaagaacgcagggtaaattcgtgggcagaacaaaatgatctctagggacttgctcttaagtttcctgaccataagatcatactcctttctcatagataagaaaccttaagccccaaaccaatgaaacatagcttagagaatggccccataggacttacctcctgttaacatgagggcacatttgcacatacagttgtcattatcagcatctttagtgctgaaatcagcaccgtgtaagatcaggctgctctgttttcctgctgtcccagtgtgaccttttaaatacaacctgaagtcaaaaagaaaaaaaagaaagataagccattcgacagaataacagaacccagaagaccagcttgttgaatgtttgcctttttcatcattttcttctttctttgaactcagcccttccaacaaacctctaggagacccaagctatctgaaccaaaagaacaaaggaaggaaaaagtttatttcattatgcatgctcaaactcatgtggttctctgatactgcaggatccagaaaacataaaaacttgggtttattgtattaatacaggtattaacctctaaacataaacgctttttacaatgtcaattcagcatgtcactcccttaatccattaatatctaatagtgcagatgtactaaacattattaatagcaataaaaggaggaagtttcattgattggggatttcctctgtgccaggcactatgttaaatgatttccagtgtttatttgattaaatttttatattaaatctgtgatccagacattaatatccccaatttgtatactaaggtttagggaagctatgtaagctggaatttagctggtatgagtctaaaactcaagctttgaatcattatgcattccctggacaaatatttgctgagcacaaactacataccagttattgatctaggcacttaagatatataagaaaagaaaacaaaaatctgtgcttttgagggacttgtattctagaggtatccctaaaattaaattcaaaatcccatctgtttaatatggcattcttcgaagaacctctcttactatctagaaacatttcttatataaaacttgcattaacctagatcagtggccctctaatggatgtgcatataacaaatcatctgatcttttgtttaaaaggcctatttactaaccccaggaatgtttgttttcaactagcatctcagatttctctttgcagactgtccaaagagaacattttgacaagtattgtcctagaatccgagaactagtgggcaaatcacaatagttgtcaaatgtagtgacctgtctgatgtctgctcatttcctactgatcgtacaagctgctttcatatccttctgggcaacgtagtgcttagaactaatgtaaacttgctcacgtccttcagtggctccatagggcttagagtagctaaactgaagttgtcgtatcgacagcttgaagctcaaggtgttctctggctaagactctagcccctctctctctaactctacctaacactgcttctccataccagcacaatgttttcatcagaatcatgtagtaatatccccttcaaattcatataggtcaccacctgtatgcctgggtcttatttatgaatcctgtccacccacagtatagttaatgggtgattcacatctctgtatgagtgagacactcctaaaacctaggctggctctgagcaaaacattacattattatgaaatagaataataaagatcaattaatatttggagatatattttaacttgtgttttcatctaggtatatgtatatatcctactgtttgtggtatttgatattatttttagcaaaaaacaatattattggatgtttgtgcaatattttacaaatattctgcagagattttgagccagagcaaagtatacaagtaaacctcagtcagtttttgttggtttcaataattaatggaacttctggttcacagtagtacaaataatcttctaatgttgaattatcacatacaagcttgtattttaaaactctgagaggcagactacaagtaactggtgatgcaaaattgtagaattttttaaagtgccaattcacatttgaggctgcagccagcccacgtggaggtgggtttcaccaggagaaagtaagatgacagatcaccaaagggagttctgggacatgttacctgggtgaattcgccaccttccagagctggtgagaactttcaattcaatcacttctttggaggtcctcagcctcccaaagatagacacacattggcaaaactaacaagagacttttgtcaggcctccatttgcagtccaagtaggaatatggtggggacccagtctcatggtcttcttagagagaatttcacacagaaagccaaattataatcagaaagttacttgtttggtgaagacagaatcagaattgagagaataagtgaatgattccaaaattaagtagctacgtctctcctagcgtgaaatctgctctactgggcctgggagagtttagcccataggcgctcttgaatgagcaatggcaattttaactctgattttttgtttctctgtgatttgtaatggccttcctttttacggtaagtcaatgccattttctccgcagtagctttaagctcactaataaagacagactttccaggatgtaatgattttctatagtgtctttgcagggaattcagcacaaatgtttgattttaaataagagactgctatgtgcttgaatacatagtttatacttttaccctttcacataagatttacaatctaagtctcataatttataattatttatttgtgtaatcaaggcaatacaaatgcatgattataaatttgagaagaaaagcaaaaagaagaaataaaaatcaacccaaatctcatcactgagtataactactcttttcatattaacaatttttagtattttacttgtttctcccctctaaatataaaatattatttatttttaaatatatacgtatctgaacacattcttataaaatttttgaacactataagtaaagcttctgcccacagccccatttcatctccctctttagaggtatccttcaaaaacaacctctctccatgtgaaaatacaaatagaaatagaattatactttacatgtttctgtatgagattattttcaaatacaaatttgtgaccactttttcatatcattacatttttttctctaaaatcatttggaaaatattgtatgaatatatcatcaatagtcacaagactaaggctgccttcaggtatctctctatatgtgtgctggtataggtataggtatataggtataggtattaggattacaatataatccacatttctttcctgacctttccccgtatgaatgttatcaatgctatgttaggctatcagtaaagagacatctttccagatctatttaagacttggaggtcagtttctagtcttggcagttcttctctggattatcaaagaagacttacaactagtctccctgccttgagtttcacttcttcttccccttccccatgaagtccatgcagctcattcaaaaacatgcatctcatcattcctctattctggttaaagttgctcggttgttcctccaaaattcaaagataaagtccaaattttttactgtgatttgcaaggcctttgaagtctagtcctttactgtctactttttcccatgtctcacccaccctaaccctcccatatcttgttattttctgcacgtacacatagtgctccagccttacccactcacttattccctctaagcaacactcttatttctccatacatttgcaagtaccatcccctcttcctagaaggtactctccaggtttgaacagctgctgaactcctatccatcctttaagatttgttccaagtataacctcaaagagcatcaaatcagcatcttcatgatgacacttacttgctgtattttaattgtcttttcacttttctgtttcccataataaactgtgagctccttgaggcatagactatgtcttactcatctttgaatcatcagaatcttgaaatcttgaacagtctctgagatagagaaaggcctcaatgttcattgactagatggatgatgggtttactaactgattaatttttggtaagctcaaggtagcaagcaaaagcaaactcaaatataaataactctaatatcaaaatatacttggtctacatttcagaagtatagcttttacatctcatttagttaggtactcaacatacctacctgggtacccacttcattgcccatccaactcaaataattaaaaaatacacatgtagggttgtgtgtgtgtgtgtgtgtgtgtgtgtgtgtgtgtacatagatacagtctctcacatccttcttatctttccagttttgtttttgttcttattttctcagagactccagaatataaaaacatgagcaaggcattatgcagatagaataaaggaaaaaaaggccatgtcttaattcctattattccttacattttattgaacaatttatttgtattgtatgaatagccaactgaaaacaatttgaaagcaaattcaaaataaaaatatgcttaaggttagtgtttcagctaaaattattttttaaaaaagaaatattctaataaggtgtgaacataattccttaaggtcctgcccagattaagcattaaaacataaagcagaagtagagagaagtctcaagatgtgcaatgtaaacagtgacatatattggttgaaatgatgtacaagtagaagggactgatatattgaggaataatgaatgtttcactgttggatacttagtagcacttgtaatttacatgaagtagtattcatccccccatgtttatatccttagcatgtcacagaggagcggcttatgctcttctaaggaagagacacacagtctcttgcactgggagataaagatgaaatgtcataaaaatcatttcttctaaacaatattttaaaaactttgcacatgaggacaactgtacttctgtggaatcccagaaggactctgggagaaactatgcagtccagagaaggtctcctgcacagttcaggggctcattctttcttagcagctctttacctagctcagagtcccaatttttggcccaaagccaacgaccacagctagttatttgatacaggtaaattaaggaccagtcactcattagtgccaagtatttctgtaattagatttaaaaaaaaaaaacttctttgagttgaggctcaaacagaacatttggatgattctttttaacactggttctggctaatatctagtccttatgtgtaattaactatcatctgtggctttctctatgaagctaataattgttccaaatagactttcagtttatcaaagaaaaatcaatatacaggatggctttgcacctgactaccgtgacagtgaattggaagtgtgaaacattagttagaatacatctcccaaaataacagcatgggaatcctggttatttatttcttgtgttcagccagtgtagacatggcctgtatgaaagacgatatgttagaagataaaaacaaaatgttcctccagaaaaaaacattagggacagacataaggaagctgtgaaaaacaaaacaaaacaaaaaactccagagaatctaatttgatgtgaccaaaaagcagccacgacatagaattatggcatttattctcatccatgtattttctcctaataaagaaaaaaaaatgagtcccttcgacggatgactataaagaatgtcagcatttttattttttcaattagcatatcatgggaaaactgatgtccattgaaattagtcattattctctagtcatctttgataaaagttactccttttcaatcacttttagaaatttcagtaattataaagactaaatcatcacatttcttaatgaatataggacaacagtgagttctattatggaagaacaggcttcaaaatattcctatatatcatccaagagattctagaactttcttttctttaaaatgggcagcccaatctcatgaacccagtttcttactaattttctctacttaagagactcactctcttcacatttttgcatcttcaccatactcaggtggccaagtgtctctttcatgatccaaggcagtgggagttgtttgtatgacaaattgaagtttggcctcaacccttttaaacagtagacagactcgcagatatctgaactttaaggtcgtaggtactgacaagctgagcagatttttattttggctctgagttctctccctgccaccatatggaactagtttatctttctcacaattactaagaaattcaaaatgaccttcatggttctctttcagaggctggtagcaatggctcaatctgacaagagtttcctgatgtggctatgatttctagttgctgcttctgggctgtctctgccatattcaacctctccaatcctaccccctttccactgaaagaactgggcaccattagccaagagggatgtcagagcatgtatgttagcactgactttttcacatcctggagatatattctataactctattgtccatacatgaacagaattctttacttatttgcaatagcctatcaatgaatatgtgagaaaatgctagaaaaatatatgaagcaaagttaatacacttacgaaaaagtgagtgaatatattaaagacattcagttatatgacaataatctataatccagaaaagaaatgtttgaaagaagtttccaaagaaaagaggatgtgagtaggaagactaaaagaattgataatgtaaagtgtgactaatcaagaattaaggctgtgataaagacttatagatatctaaaaacattttaaaaatatacagatcaagcagatacaggtaatttggtacaaaataagtacgaatgaaagaaataaccctctataaagccattaaccaaaactcttccttttttcctcctcctccacacacacgaaatggagaaataaataagccattggcttctgcaaattaaggctgtgtcatgaccacttgtgtctggaaagacagcatgacatcacagagtttgtagtgtacctgtttgggtttgcaatctagctcttattctttctgatcctcagttgcctcatctgtaaaatacctctatgtcctgccaatattttgtgaagattaaatgaggtgatacccggaaagcccttaaaaagactgctgcatgcaaaataaagtaagtacttgactatttgcaaaaaaattaaagtaatcaaacttccttaagcaataaccataaaatatacagtagttcaataggcatgaattacgggaatgactaaggctaaattacacaggtataaacatatgaccttgatagacatatgtaagtgttctgagagtgataaaaacaatgacatagagatacagctcatgaggacaggcatggaggcaacaagccagagaaattaaagatgaaaaggatcaattttctcaaacccatgaggccccatatcctttggaagtttttcttattttctatagaggaagcagagtactaaacatgaaggacaagaaaccaaagagttgctttgctgactgactatgtagttaagatctatgttaatttgactctagatggtctgaataaatatccttcaattaaaatgtttatcttttaataaattaaaatttcagacttttgagaaccctacaattttcttgccatcatataatattttgttgaatgaatccaatatatatttgtttggttttcctttctttactcataattgatactggtaaaaaaaaaaaaaaaaaaaattcctggaaaaatcatccatgccaacctagcctttaattctcatgactacttgctgaaagctttctttttctcattaaaccttccacaattggtgtcatttgttttaacagggaactggataattgggaatcaccagaatttgtgcataataattttaccattatgttaagaaggaagacattatcttatttgtttcagaagctacagatgtcctgaggtagatatgctattcattttggaatatgtgtaatggaagatgtacacaaaagtgtgaaaaaatatgaaaaatgtttgagatagtaatggtcctgggaatctgtgctatgattaaggaagataaatttccaaagctacagaaaacctcaccccaaatgatgaaaaatctttagaaaattgagtttcacttaatctctgattctcatatgattgttttagatattagcttgtataacacctgtataaattgtactctggatttccatgtaagtttttgataatatacatttttaatgtctccccttcacttacaaacattaatatcttgtagaatttagataaaatgagcttatcaaccttccaggtcttcccaagctcttgacattaggaacagtgttagcagtaatttttgtttcaaaactctggtaaaatacagttcttagtgttttgcagtgatagacatgaagcttgcatatgctcaaaactcatgataaatttttcctccaaagaaaatagcaaacccacgtactgttattgttgtgtgcctttcaatagtgctgacagagtgctctctattctgtacatcatatacatatataatatatattatatatgtatgtatatatatgagatctgtgacaatgaaatatttcccaaatttcagaaatacatgctcagtgattatgtttttagttcaaaataagataaatagttattccagtattccttcccttttttaagaatacataaaaaaaaaaaaaactgagtgccaaaatgaatcacgtgacaccaagacccctgtttaaaacacaaacagtcccttaaacatatttggatttccttggcatcatgtgtgactgatagagtcagcttccagtgagtgactctctggtctgaccctcttgtggtgcctaaaagaccaggccaatggccatctcagagagtttatgggttttgctttgttaccaaaaattaagtcaggaccttgtaaaacttgtgattgaaattggtgatttttcagtctaaacaaattctcgggaggtagatttgttctcattttttatttgtgtttaaagagcaataagaaactttctttccagcattcccttggggtagatagagagaggagagggtaagcaaaatgttgaaaaccattgagatgcattgtctgaggtttcttgcaaagagaaaatactttcccttgttgtacttggacattgtattgctataaggtctgcaaataagcctccagcatgcattagcagattcttctgatgaccaaagtcatcagtgtgcttatttgtctccacaatcagtataagctagagtcgaaaatctttgtcatggattctagccctctgttatatgtagcacagtaaagccctgcatacaagatgtcctctaaatacttgctgtcctctaaataaggcagactgtctctcatctctgcatgtgtgtccacattgctcctctggctgggatctcaagtccttcctcctgccattaactaccatacttgcctcatgagcgcttactcatttcacacatctctaaggatttcctctatgaagcctttcccagtcccatttaatctcctccaatgaaccctatccattcccaactccagtagaattgaccactatttttttttaagtaaccaatgatagcctaattccaagggttctttcccagggactgtgagtgtaaaggtgaattacacataaatttatacaaaattttgtgtttcttcatcattctagggaaaaagtccttggcttcatcattaaaaaaaaaaaaaaagatctatggttccttgatcaaaaaacaaaacaaaagaaaaatcaaacagacatgctaaatcacttcagctaaaacttttgagtcaactattccatgttttgtttccttctcctaaactattagccccacaagagaaggtatggtgtgtctgtttggtgtaaccaaagtgttatttctgcatcagcatcactttggtgcacttgataggactgagagctctaggtcttaacccaggataagaatctctttaggtgcgactcagaaatctgtactttaaacaggcaccctagttacctatatgcacattcaagaaataaaacaactggcatagtgccaggaaaataatagtaacacggtaagtgtatggtggttggctggctggataaagcaatgaaggcagactctgatttcaaaagaactataataacttttaagagagtaattttagtaaagttatgtaggtaaaagcaaaactgtagccagttaagagaaatgaacaatgtatgctgtgggacaattttattaatttttttatttacttgccaacaagcaatatagaaattcttgcatatcatttgcagttaaagataaaagagataaagataaaagaagctagagtttaatagttctagaaaataaatcttatttaagcaacaacaatccagggaacttaaggacatgatactttattagaaatcttagtggcaactgtcattttataccataaacctttggaggcaggatttttgacttgttgctctttgaatttctggtatctagatcaagaattgccatgtattagtcagctgtgtggattcgcacaaaaaaatcacctgtgttgaatgcacaaaaaaaccttgtcaatatgtcttttatatacctattaagaaatgcttttttttcgagacatgtgccaagcattgtgaagaggttcctgtcctcctagagattacagtctaataatagggaacagcaattacaacccagtgtgatgtgtactctgataaagacatgcccagagcacagtgggaggacatggaaggggctcctaacccaatcaaggacgaagagctctatggactgagctaagacttaaaggatcaagaaaatccaattaggcaaagtgaataaaatcttgaaaaatagaggttgagttctgtggggttttgtttcatccacagtagcttgcatattgttgttgctcatatttaccaaacagagtaatcaaaatattgagtgtgaaaaaattgatgtgagaaaaggccgtatcagagcaatattgcccccagaggccatggctgcttacctgtcccaagtctgccacaagcagcggttctcctttctcttagcatcatgattgctcattattacccccttacgctctaagcttaagcaacagttaaccacttgtagtttcctagcaagacgtgctgagtctcacttctgagctaatccctcttctacccccatctctgaactattccccaactaataccaatttgccacatttatgtcactttaggccactatttggaagctttctcaaccttccaaaactggttagccctctttagtcacagcacatttgtgattgtaagtgaactgactgtgttcgtggcattgtaattgcctgtttggctgtctgcaaccatccgaccccactccatatccatcacatatgggtatgcacctgcatgaacacacgtatacatgactgtactgaaatctctgtggacattttatcctaggatagcacatgatggatgcataacaaatatttcatggagccatcatctttttgatagtgaacagcagtaggggaacctagagcagtggatcacaggacatcaccttagataatttattggaggcagtgcttgctagctggttctggcaacttttgccaacctgtaagtttctaggacagcagtggtctgagtcttagcattacccattctgtgacaggaatcctctgggaatccttagacctaacagcatgcaggcatttgttttcatcagcttgaaaaatatccaagactctagagactgacattcaactgcatttttaagtgaagagattttcccaacacttaaaagacctaaagaaggtgcaaagtgactgtaagaatgtgctcatccgtgcctctgaagacccaggaagccttttttgtcttcagtatttcatctcagtcaaggggattaaaatataaattttgatgattaaaacaacttctctgttttaggaagtaaccacaacaaaaatcacagtctaaataaaagtaatgcaccttccaagttggagaaattatttgaaaacacaaataagactctttaaaaccttgagtttgaaaacctatgttaggaattgagggaagtagaaactgccaggagatttcctacatattttttcataccttgatcagtccagaactgctgtaaaaaaataactttcctcttagtatttcaacatatttgctactggttccatccaggactatgtagcccagaggatcagagaaataagaaacatttcactgaaagaaaaaaaaaatgaaacaagttttgcaatatctacaaaaatgcagggcttaaatttacatgggaggctcgagagaattcttttcaatccacatgaatttgttttgtccttgaaatacatacacggcatgggagtactttaatgatttaaaaaaaaaaaatggattggggaactggaaagaacttcagccttacctcctcattttacttctgaggatctgagacttagaaaagtgaagcaaattgtccaaggtcattcagaaaagtaactgcaaatccaagtctagagttcatgtctctggattcccgatacagtgttttacaaattacatcaaactacttcccaatgaagatcttggccaaaaacaaacttgcgcaaaaagatatttaatgaccaaattattttcaggttgttttcttcacaattttggtttaaaattctgttcatctcttcatgtggaatcttttccagaacaaggcttatgatagacatcaacagtcagttctaatctaatgatgtcatttatcctcaataaataatataaagtcaataaaatataaatatccacaaaatgtgcattataaattatgtagtaagattataatgacaagatgtgcattaaaaaatgttaaacattatcattcggacttaactaatactaattttctattgcttaaaagagaggctcatgataccatctgtgacagaggatttactaattaagttaatagcataaaagacaacaaaataatgaactgtaaggaacaaactgttcccaagatctgaaaataattacctgcaaaatgactttataatggaatatgttcactaaaattgtgtccttttaatattaaggcagaaaaatttttatatagttttcttttaacatttaaaaatagtacagtgaaatttatttccaactggtaaattctacttttttatttataataatataacacaatggtttttaaactgtgctgtactaatgtttgagataatagcaagaggaaatattatactaccttcccacaaccatttcaaaatagatcagctttacgtgtttcatacattatgatcctttgtaagaattttggagagaataggtattccattaaaaaaccaaaaacaaaaccttaacaagtgattaagcttagcccaatcaataatggaacaaattaatcttttgtgcctttggatgtgatagaatgggaaatagacaatatcatttatttagtattcttctcaagaaagctttaatctgaatctaatcagaaagaaatagtcagataagcccagaaagagctgttctgggaaaagctgacccaaagtcttgaaaaatgtaattgatagatgagtggtagactgtttcaggtaaaaggcgactcaagagacatgactgcaaatgcaatgagtgaagctggatgggatcctgaatccaagtaaataaacaactatcaaccagccaaggacattgttggagacaatagtggtgatttcgatatagaatatataattaaaaattgtttattgactcaataatatatttcttgggcatgataaaaatttaatttaaaaagtctgtttgctcttttcttttcttttttttttttttaaagacagggtcatgttttgtcagccaggcttgaatgcagcagtgcaatcacagctcactgcaacctcaacctcctgggctcaagcaatccttctgcctcagcctcctaagtagctgggacaatgggtgtgcaacaccacgccaagtgaatgtttgtttttttaatttttaatagagacaaagttctcgctatgttgcccaggctgatgtcaaactcctgacctcaagcagtcctcccactttggcctccctaagtggtggaattacaggtgtgaaccactgtacccagtctctaaacagctttcgtattagcatgatatttaagtttaccaaatacaaggtatatatgtacactctttttgattcgaggatattattcccactgaaagataagaaaactgaggcataaaagtaatatcaacttggttaatctgggtactccatttccctgaatccccttcattgtaaggttctaagctggggttggctaaaagagaattttgtgtgagatttggaaggcgaaagtgaagcagtggcctgactctgagaacgtcatcagatatggtgaagtccaggggcagagatgcctgacagtttctacattgtgtatttcttcacttagcacccagcttgtcttcctgatgctggcaacagctccagacccaccacaagatgcttgactgcacaacctcatttaatggaactacagcaaggcaacaaatttctgtagatcttcccttttgtggttccactttggtggctacacgtgtttggtttcttagattttcacaagctctggcttgtctgccatgccaaatttcaagcatatgttttaaccttatttccgtaagactcatcatggctctgctcccctgactgaacactgacaaatacaaccatgccagtttcccaggtggtagagccagatttcttctcagcctccacatcctgattccgactccagagctccttccagtggacatagcatctcctcaaccctacaataaatctgctattattaaaatatttttaaagcatttattgttgcagtggtggttgtgtatttgtttttttaaactgataataaactctcaagtgtttattagagagatcaaatttaattttttatcaaagaattgaaaggtaataaaaatagtgatgcacaggtaaaggtagttctattgtagaaaatttttgagctacaaggtgctttacaaatactttaacttgtaagaatagaaaattgagaactggaaagataggtaatgtgtccaaaggcattcaaattattaaagagagaagtagggttagaataaacatatactatatcttagagtatgtgttttgggtttatttaattctagaaattaactgatgaacttctttatttgaggatgcccatatggtgggtagttataagaccaaatttcaaatcggactcctactcatcgttatcagtgcctgtgaccttgtgcaaagtactatgcctcagttttctcttgtgaaaacaagacatctggtgtatagtatgtgtgcctcaaatatagctagcttagtcagtaatttggctaaattagttacatatcttgaatttttccaaaatgggttctacactttaaaagcttagaacacacacacatacacacacacgtgtacacacacacacacactcaaaggaagggggggggagagagagagcacaagttaaagatagttaacagtcactcattaatgacttataacaggatttggatcctggatagttatccagagtgctacgggtcaatgggagcacagagtatccaaattggcctaagaatgagggtgatgcatttctctgggaaatcagtgtagggaggttgagaagggagaggtcccaggatccgtggcagagtgaagcatgcagaactcagcaaagggagattcagggctcacatgctgtcatggtgaagacttcaactaatctgaagtggaattttggattctgaggggctcttcagaattgccccaaattggggcaagagggtcttcatattcttatattgaccagtcattagatacaatgtatcttgcaagaagtaatcttgggtgatgttactttctttctttttttatttttttttttgagatggcgtttcactcttgtcgccctgactggagtgtaatggcgcaatctcggctcactacaacctccacctccggggttcaagtgattctcttgtctcagcgtcccgagcagctgggattataggcatgtgctaccacgcccggctaatttttctttaactacaaacagtgcctggaaaggggacttcagctgcaacctgtcagtcaacatttcccggaagtggaagaaagaagcgctttagtattgaaggaggcaatgggttgacacgttacatctaccacagtaggtatcagggaagacttggaataagagagaatcttaaagatttaagatgtatccatgtgacaaagttaagtttatgtgttgagtgagtaagaatatagcataaacaaaggcatggaggatttagggcaatcgcaaatagttaccagaacataaccgttaatgagaagggtatccaggtaggtaaagttagggagagtgtatggcagcaataggtgcataattaggtagtggccaggtcacgaagagtcttagtggtagacttttacctgcagatatttgaacactgttgaaatatatgaaggagggaaagaccaagttgtctgttagaaaaatcatctcaacaacagcatggaagatatatatgagagtatgaagactaaagaggcaggaaggttctataattgcctgggtgttagatgatgaggatctggataatactacctctctagaggaagtattaaataatttcacattgatacatgttagttcatatgctatgcttatcatgacactcttacattattattttttcttatttatattctcttgggttctacagattttattttctatctgagaaaattatttggagtttccttagaggataaaagaaaaatatgtgtaatacatgcacatttataagctcatctatccattcacaacactttcttttaattaatatgtcaagagcatgataaatgtttttttaaaaaacaacaccacagttaggtttaaacattaggaccacacctgttacaagaattttcaaacaaaatttccatgatagaatatgttttagaaaataaaacctcaaacaattctgaatttaatttaatttaatttaatttttgagaaaagttatagaaaacaaaaaatataaaacaaaaacctagtatgaatttcatagttttatatttcagtcggaatttagttgaatttgaccaagtcaactgaccaaaacctcagttttcttattttttaaatgtgtctaggcccagagcagtggctcactcctgtaatcccagcactttgggaggctgaggcgtgcggatcacgagatcaggagatcgagtccatcctggctaacacggtgaaactccgtctctactaaaaatacaaaaaattagccaggcatggtggcaggcacctgtagtcccagctactagagaggctgaggcgggagaattgcttgaaccggtgaggcggaggttgcagtgagccgagatcgcgccattgcactccagcctgggcgataagagtgagactccgtctcaaaaaaacaatgtgtctaataatacctacctccaaaagaggtttatatgcttgtagtgttaaaaatcatttcataggttatggaatactgtgcaaatcttagtattaatacttgaaacaattgatcacaaagacacacgccaattcagagggacgagacatgaatggacaaaaagcacatgaggcagtgatggacaatgtgagttctaactgcaggccacgggaggcattaatgggcctagagaagcagtactgggcatacgtgatgatacaggcagggagaaaagttgcaagggcttagcttctgttttcaggcttctgttccatttttctttgaaaaagcgaataacaccatcttatagtgtgtttactttaatgaatctttcaccagagtaagcattatgttttaatgagttctcatttcccatttcatgtcaacgtgaatcgtatacttgaattgcatgagaaaatgatgactgcacatctactttctgttaggtccctgcaggaaagaggccagaaccactaacttcatgtcagcagcatgacagaacagaaaccacattgaatgaggcaggagttagacatcccttatttaagtctttctccctttttgggcaaaattatatatatgaggctcatatgtatatatatgtgtgtatgtgtgtgtgtgtgtgtgcgtgtgtacacatgcatatgcatgtgtgtgaggcttgaagagttcatatatattatatatcatatattatattatatatatattacatatatgaaccatatatatatatatatatatatatatatatatatatatatatgagcctcagctttccttcccataaaaccagaggtttgaaattaaattgttacatttcttctggctttataattttgattctcaaggttcacagttctatcaagaaagaaaaatggggatatcagagtgtatgcatcaccctagcagggaagacttactttttgatcatagatccctactgtgtggtgagaatacaaaatcacacagatgtcaaagaaatgagaaatgctcaaaagggcagtggggcactctaagaggaggtgagtactccttcctcatgcagatggcagaatggcatacacatcatacactccgaagtgcaccacagatgccaacaatcctcctaaccctgccccaacactctgtcccgcaacaccctccaagcctgacacacatgcatatgcatgtgtatgcacacacacacacacacatgcagccacctatgaaaaactgagagacattttggaaaggaaccaaagcaaattcttcaggagcctaggaaaagactagactaattatttgctagtcctattgtcaggctgtctgacattagccaagtttcatatagtttcaagtttcaggtcaaaacatttacataagagtatccctgatgtttaacagtggttttcttgttataaaactttcaaaatattgacctccttggaaacatttcttcttacactccattgcattttataaatgtctcttctttggtttcttgagctgccattaagtacaccctcgcttcccctccacccccaccatgagactatcaactcttttagatctatttctcattctctgttgtggtgacatcattactatttgtcgagaaaatgattattatgtctccaaggatccaaccccatacataatccattaaaatgaaatgagttgtgcctatgaaaatatgcagaattcaaacttttaaaaaattaaaaaaaaaaggtttgtcttgaaaagacaaataagcagcagaaacagttgaactatgagataaccacacaggttgaaacaaaacacacgcaagggttgggttgctattgttgcaattacttgaagcaatgtgcccaccctttaattcatacaatcatattttcaagacagaggtagagcagtcacaatattgagagttaaaaatcattacaactctaatttactaagaatgaaactgaggcacacacaattaaagacctgctaggcatcaagaattgcattaatgagtagcagtagaagagtaactaaaatatcttccctgttcccaaggaatgccagccagtttttagtgacctagttagtaacaaagcttgactttgacgtctgtaagaccagcgcccagtagaattccaggaacacagaagtaacacaataagtgttcgtgcaatgaatccaccacatcacattatttccttagccatatttttgtgtgtttatttttccctagtagacgagcttctcattgaaaaaggataattggaaacatgtatcattaagtgtatagtttatctatttttacatctgcaatcatgtattatgtatattgatgccattattacaatttatttttgctttttagatttaccaagaaaaccctctaaatcatgcctcatcttctcttttatgtaaatcattcaaacataaaaaaattttacttttgtcatcttcaagatcatttgaaaaatgctaattcaagaaaggtcatcaaaaaaagtagaaccagaaaatctttttttagaataaagagattatttaagccaatgagtttgagtatgaaacttatcagttttatatatatgaattcactgcaactgcatgataaccacagaacaacagtatgcttgacttcattcaccattccctaaaatttaagccaatatcaaagatagtcaacctacgaaaactgaaatttaaatctttgaaaaagtctttacaggcttttttgtacctctttgtaataggtctagacaaaaaaaaaagaattttcattttgaaggatgattttcatttctttttttcatattttcccactacaattattaagtggctaggtaaaaggtagtcgaacactacactgtagcatgacttacctatagttttgcttttcatttcctatgtggaatctgtcatactgtgaataggctcggttcccttcccagtccattaactcaattcttagcatgtactgcctctgactggtaatggcaaaaataaactcattccccagccaatattcaccggagggatttccaaaaccctgggaaacaatatagagatgcagttgttactttagagaggaattcttttcatgttcagcatttaactattttctaaataataattaaaaattattaaaaagtaaaggtttttgttttttacattttacactttttctccagtgattgacatttcaataattctgtgtctcttcatcaaagcttctgtctaattcttacttagtacaataaaacctctgttattcaaatctgtgtggatgagacattttgtataaaataaatctagttaataggtttaactggaaaacaattctcaattcaaggtttgcttttgaaaatgtttctaaattactagttaacaaaatattttgaatagagtttaaagatttttcaatgaacactatgagagtgatattagacaagttatttaacaatattatttttactattattattcacaaatgcaattatgtttcaacaataacttcatatttaggttggtgcaaaagtaattgcagtttttgccattactttcaatggtaaaaaccataattacttttgcaccaaactaatagattactagaaccatgacttttggagctttaactttcttatttttaaatattaataagcaaccctgtaaatccatgactgtaattatttacaaagctgcactggcattggaattttgaggcagaaggctgatttgtaagtgctcctgagtgaacctagctgactgcttggcttctgaatgtcaacatgactttattgttctctttgggggaagtcaaggttgttaagtattcaaaatagtttctttgtagggagaaaaaagtggtcccaaaagaaagccagcgcttaatgttggagatgttagtgataggaaaagaaagaacccctagaaacttgctggcattctagatttggagtattcacaattgcctcagaaaatactcattggcagtgcttgaagttcaatgtaattcttgatctacatatttgtttcactggccatgttgtgagctccctgatgatagaaactgtgttgtatttgtgaatttccaaaaaccagtgaagagctgacatgcactgagcattccaatagggttgttttgaaattcaaagaaaaaggtagaaaggaaaggatagaggaaagaagcaagaaagggagagagaaatggaggtaaggaggaaggaaaacaaaatattacagcattttacaataacacatggaaaagtaaccttaaagcacaattcttgttgtagacagtacagttgagtcttggtgaaatgtttcttaaagtgcccaactgggtcacttgcgcactacctcctctgccaactgagttacttaccaaagttcaaaggtgtttggtaccaaacccatttatgccagttcagttattgcaatatttataaaatgttatgcaaataagttaaatattagtgggaaaagagagttttaattttttataaatatccggatttgctcaataaaagcaaattagtaaaactttttttaaaattacgaattgttggaactctaaaagactgggaaaaattttaaaaatttaaagaatttttaacatattgccttgcatgtgtcttcatgtactgttctatttttaaaaaactgaaactagagattggatgcattctactatgggaaagttttaggaaagaactgatgacacagaattccaggctttggccctcgttttatttttttttattaatgggtatgtgatgtatactgttatatttaaagttaaaattaacatatgtgtacacttttaaagttattccccaatttaactaagttttttgataggctgaatatgcttggtccagattgcattgagtatatactcttctgaagaccatccacccatagctcacagtaaagctataagaccactgaagttagtactccattggctctttacttctctgttcctaagatgctcaagtcacactttgtaaaagtttcacagtggcaggaaatattagagcaatttctggtgtgctaagaattttacacatttttatggcagccaatgctacctactaaggagaagagcaaagcttaccttctccaaagcataaacaaaacagaaagttacaggaggctgaaagtcaaagaattagcactttatcaattacaacagcccctgggaagaaaaagaagaccactgggattttccttgcatttttttgcagctcagacatgtcaaaactctccctcttgccacttgatgattcccttttctgtgcagtcattgaaaagggattcaacacttatactcaatgtgaataaagaggctgggaatgatgaagtgttaagttttgggtcacatatttccatgctgttgaaagcgctgtgtggataaaactctccaacttccccagggaaacacgcagtgatcctgggtgagccttagaaatggacaagcattagcctcattcctaggacagcctccatccctgtctccacatgcaggcctgtacttccctctaaatggaaataaatatcccttcctaaacagtttgcatttttgtctttcaggaagaagtgactaaaaagaacgcagtataatttgcatttagaaactaacatttatttcgagctccttcccaaaaaactgtccaagcatgctctagtatgagagcaaaaggtttgagtacaatgaatcaaaatggctgcaatatagggaggaaaccttctaatagccaagtgcagtgatccagaaacaactgtttcattataaagatgaaaaatacgtgaaagaaggggaattgtgttcccacattagtaaactgtcttttggatagtttaccaggcatgaccacagatctgatatgtaggacaaaggcttggcttggatgaaataacctctaccccttatctctggctccagattaaagccttgaactgccacatatttgctgtagaaatatcgactttgtttctgagcctcagtttctctgtctgcaaaacagggattacagacatcattttcatatacaaggttttgagaataaaattgataatataaccgaagcacttaactgagcactgatagacagaaaacacttaaaaatctagctgttgttatagttaaaatatatgtcataatacacagtaattttctggttagttgcttctcttccatgagactgtgagtcatatgtggggaaacaagttcctttctactttgtataagaaaaggaaaaagaataatcttgggtcttgtattagcccaaaaattaataaagggatactgaaataattatttaaaaggctctcagaggactaatgtaatattttactaaattgagagttggtttatacaaatgagtattgtcattttaatccaaaaagttaattattaaataagaaattacaaccaactgatttcaattgggactaaactatagtactaatgaaagcacagactactttcttattcttacctttgcttccaagtacttaagtatctgtttccttcgactctcccttagtgctatctctttcaagccctctctttccatatctcacgagttttaggagctacacaagaggtaatttttaaggtattataccatgctaataagttaatatttgtaataattgctttcaaccaggaatgcatatcagaaacagctgtgggggttttaaaaaaatacagatggttaggtcccccgtgaagattctgattcagtatgtctggggtggactcagagggagagctatacatgtaaaaggttgcacatgtaagtctgctatgaactgaaggtagagatccatataaatatgatgtggaatagatattccaagtgcaaactaaaaagaacatattaattaaatcaaattatttgagtggtatacagggaaaatgcaggagtaaaatctcatcttcatactgaggtccctatagggaggcaaattttgattacatgtctgggactgtccttcaaaaattcatattcatgcctaaaagacagagtcaaccaatgcatatgctccaaaataggcttacacattatggcacataacagtttaccacaggtctttattttacccccaatagcctgtaacttccataaaaataaaaatgaaagtatatatgaaattctgtgctgatattgaaaaagcagcaacgaatgagtaaacaattacaatacaatttcctctttttcatgaataaaatctaaggatactatgccatgtacttttgtaaaaatgatgtttaatgatgtcaaacacaatcacctgaaaggttttgattcagtaactcagatacattgttaattgattttatttcttctctaacgctctaataaaaggataaaaagacactgaaatttaatctgaactaatgctgacttaaaattggccttaaaaggcacatattactcaaaaacacatgcaaaggaaagatcaacatttgttagtttttgccaaaacctgcagaaatgttcaattttggtttgtgcttttccaagttaataaaataattgtctctgatactttatttgttttgtctgataatgctctcaggaagcgttgactttttatagatgaagtaaaattgaaaccagacacagcccatgtattccatgggttgcatcttttttcacacaaattatttaaaaaataaaaaacagataagacagcgctgtggctttcagggcactttcatatgcagttaaattgtgcatctcctctaaatgctgagacgtgcaactcaagaaagactgaaacaaattttgtatttcaaaatttttaatttcatatgcatttttctctttttaatgtgaagatgttaaaatatagctgaaaatgtgctctcaacttctttccagaaacaaagaactcccagaaggaatggtgctcacactgaaatttttgagtggataggaagctctgtttatgggggtaattgttctcaaaataaagcaagtttgcctccaggacattagtcattgcctacaacagtataaaattaggccattttgggtactatctggaactcctagcctcattgcgttttatatgtgaaagtactgctgataagtgttactgctggaggccactaaagggtatccttatgacttgaaggagctaatatcttccctaagtgcctcattaaaaagcctactccagactttcctttcagacaaacatctttacaaatccataaaccagattttgctgaatctcctcatgaggaaggttaagtgacagctaagcttaggtaagatacttgtaggcttaaagccaatgccgagaatccaaaaagtggtaaacctttcatattgacagaggtttaaaaataatgataatatatagtatatatttgtaattacatgtgatggaaatcttatgaagcaagaggcagcccatagatatcaatcactatgaagggaaggaaggagagaggaaaggcagaaaggaaagagagagaaaacttgatttctgcactcattgcccaaggaagaaatgtagcatcctagtatatataatagtagattggtaaagactggagaagagttggggcatgccaagttcttgttatcccgaaggatgtacacccttagctgaagaagtgagcaggcagttctttggatgcaggaaatagaagtaggtgtgattgataagaactggcataaggagtctatatccattcctggtggagtcatgttattttgtctttaggtgaaagaaaaactctagagaaagaaccgaaacactgtctaccatgtgttttaaccatcttgtaacatatgatgaatattttcaattaaaaaaattcagcctcatttttagccagaatatttcaaaatgttggagcttatctcattttttgatcatgcaaaattgacattcatctgataaatgtttcaagtttgaataaagcatgatagcctttcttattttaaaaaagggaggaggggtaaactccataaaacatgatgattaaagaatttcagttttgttccaataatgaaaaaagaattgcttagaaatggatatatttggtaaatacttacaagacatgaattgattccatacttaacaagtcagtatctcttacttaacatgcctagcttgccaaggcagcagatgtttacagttaagaattcaccattttggaaagtcaccatgatgacaactttatatttatttttctgttatcattaattttaataataatgtatttcagattagcctgagtctctatctacagtctgattttcagatgacttcttcacatcacattttagtggtgaaaataatcatgaattcagatggtttgcaaaacagtatttttggcatagttaagtgaaatttttgctttgatgttttcatcttggataataaaaataactactgttcactgaaaattcagtgtgccaaagtgctttacttacattacttctaatccttgaaacatcactgtgaggcaggtgaagtattatcattgtcctattttaactagttagaaagctaaggtgcaggttaggtgatctgtcgaaaatctctcctcttgtaaatggcagagtgaagactataattgtgttttgttttgttttgtttttagacagagtctttctcggtcgctaggctggagtgcagtggcgtgatctcagctcactgcaacctctgcctcccaggttcaagcgattcccctgcctcagcctcccaagtagctgggattacaggcacgtgccaccacacccggctaattttttgttgttttagtagagacggggtttcaccatattggccaagatggtctcgatctcctgacctagtgatccacccacctcggcctcccaaagtgctgggattacaggcttgagctaccgtgcctggcctataactgttaatataaacataattcaaagtctttttgtttttgaatatagataatcttttatccctcatatatttttagaatcacctaggtaggaagaggccttcaaatctgacctagcattccaattctccataccaatcccaaaagataatgatatactttctatttccactgaagatgggggggggggggggcttgccacttaataggcagtctatttgatgttgggattaatcattagagagttttgttcatacttggtcaaattttgccttcttggaatattactccattcattattgcactcccctctcaggcagtgttcaaatgcacattctaattcagtaaatctggtccagagcttgagattcgtgtttccattcagtttccagaggatgctaatactgctggtccctggaccacattttgagaagcaggctctactatcacctacctccatccagttaactaaaatagctatcaggtttatgcctaattctttttttctccaggtgtttacctgttacagatgtaatttctaaattcctcccatcctgcttataacccctaggataagttcacttgtttgaaaacctctagaattgaaactatgtttttgatgtaaccagaacatggcagacaccagtgagttctgcattttatgtgaccccctaaactactagtaatgtacactgagtacattaatctttgttaattcaaaatgagcttagaaccaaataaacctctctttcaaatactaagtccttaaggcaatttgtcacccttaccctgttttctcagagttaatttaggtattttttatctaggtgaaatattctacaatcatctctgtggaattatatcttgctggcttcagcctacctttccatcttgagtttatgaaataacaaagacatcaggattccaactttgtgtaagtccaaactttttaaacgtgctttcagactgttcgactgagtatctgataaaaatgtagatgcagtgacaccactagaaacctccattcatttattaaaaccccttatttactgtcatttgaccaactatgagcctattaatgggcaaactctgatgcaaatcaaccatagtttttacaaattgtctgcaagaatatcaagacagaactgaggctagtatagcatttctttctctctacctggtgagagaaaatttgtcaaaaagtcaagacaagaattatctagaggtttcagctgcaaaagaatgagaatccataaatatagattctcctgcattactatgcctttacattctgtcagcagattttaatagttaatattgtaggcaccgactatgtgattactggattttggattatttcaacccttgctcatctctgtttccttttaaaatgggcatagtgttagttaatagggctgatattaaaaattgataagaaattacatatagggcagacatattgagcattaaaaaagagaagaactgtgatgatgatgatgatgatgatgatgatgatgatgatgatgcctgctgttattttgcagaccccagtgagccatggctcacagttcatacctttgtgtactcctcgtgccttaaatctggactttccttttgaccaaccataaccaacagaatgcaatggaagtaacactgtttcatttctgggtctaataaaactaaaaaaggctgaaagctcctgctttgtctttggaggatgacaagtgctacgtaagaagtctgataaccctggatcactttactgaaagaagcttagcttagccacatggaaaggtcacatggagaagcttccagtcaacagccagcaacaattagccagttatgtgggtgaggccattgctattacccatcctgttccacaacctgcaaccctgcacagctcccttggtcaggctcacgtatccaacgaaggtctgagttctagcttcccccaccctcatgcaactaggaacaaatacagacaatacacaacagttcaccaaataatttcagtaatacgtttttctttctgacgcacacgtggaaatcatttactgaaagtgatttatgagtgttttgtgtctaatgaaaataatactaatgtatcattttatgtcaaaaataactcaaaaccacctaaaaataccaagattcatcatatagtatggagaagataacttcaagataaaacaccaaaaagcaccataaattcttgcatcttaccattttatattccttccagcctctttggaaatctagacttccatcttcacgatgttgtattacagtccaacctcccccattgacatccatattgcaaaacacctgacaaatggaaaacaaagtcaagtaaaaaatacttctactttaaaaaacatatatcctacatgtttcaaaataggaataaggcgaacaggtctgcagattacaaaaaccgaaattactatattgaacaatgttaatttagatatattattggttatttcttcctctgattcatatttgagttatttctgattaaattccatcaatgatgaataaattacatgcacaaattttagtcagctgaaaattaagtctttgtctcagactatacaacattttaaaaaatctttgttttaaatgaaaataagcatttgagtatgttcaaagttttggaaatgctaccaaatttccaaagttacagaccatttgattgccaaaacacatgactcagaattttaaaactttaaattgattgaaatgggagtacaataagaataaaaaatttttaaaatataatgtctttaactatcacatatttcattgcctatcaattcttatatatgtacatgttacagtagatatccttgagtcaatatttcattagaggcaacatttgtggcatagcatatgtagaatatattatttgcttgtattttagtcacgaacaataacaggagaacatgacatattgtatctcttctgactgtgacaataacttctttcccatgtggaaaatttatacaaatctttcaaagacttatgcatattttaattattcaaaatacaatggtatttatttagaaattgactcatttcccccagggtctacccaagaagagaaacatatctgtaatgggattatcgtcggagagcaatcactgtaattgatgtagcatgaatgtggcagcttgattattcaacggggactatgggaaacactatttcctcaacaactgaatactaaagcatgttgaagcttggctaaaggtgggatatgatgcaacagcagcaagcaggctatgaggacacagagctaagccctgattaaagaaaaaacctcaagtgttttccctgaggcattgcatttggaacacaagtagcaaaaagggtataaaagcagtggcaagaaatgtcattcaaagagcgaattgtccatgtacttcctcagagtggaagggtccaagatatacatgcctacttgtgggcatatgaaataggacaactctcctcccaaggctctcgccctactttgacaacagccacacatacagtatgtcttcattaaccctaggaattgactcacctccaagattgtacatttgaaatgttgattcctgtcccagtagtccccaccaccactattcctttaatttctgcacctgctctcagtcaacataacctcgagctacacttttattttccgtaattctacttcatttattcatttattttttgatttactcaacaaccattcttgggcatcagttttcacttacaactgggggtattattataaataaaatatgggtcaggtactcaaacatctccaagtttcaatagtgactgatcccatagaattaaggagacagagttcacaattttcagctctaatagcctgaagaatcatggagacaataatctaaatgagaaatttaagaaagaaaacacgagcaaagaaaatgatcatagttttggatacctcaaaggctagcaaagaaaatgatcgtagttttggacaccttagcctttgaggtagcacagatatccaaagaaaaagtttatcgagcacttcgagatgatctagaccaaggataaaaatatggataagagcataaggaagaaagaaaggaattgctattaacaatgacatgcttgttaaggaccaaataatataaacaccttacatgcattttctaatttattctcatgatagtcctagtaggatgtaggtatgatgatcatctccattttacagatgaaaaaatactgaggtttagagtagttcagtaacttaccagtgattatactcaacaataagctctggatctgggatttaaaattgatttgaactggattcagaattgaatcctatgtctacctaattgaaaattattgggaataatctgcttaaaagcatttgttaatagcatgaagacaaatgcaattacttaaataagtaaagaaaaaggtggaaacagatgtgtgtggcagggagtgagaagggtcaaagaacgggctttggtgaacacctgagaaggacagaatacatcaggaaactttaggtgggcagggatttctttcaattgactgctgtccccagtacctagaggtgtgcttagcctgtagcgggtactgaatgaatatttgataaacaaatagagatggaacaggagagataaaataggaaaatttgattaatggaatgctaagaaagatggatttagagttggggaggtgatcatcaaaggtttcagaaaagtcaagataaaaaatgattaagaaaatataacttcaatttgaatgaagaagcctttagtgaccttggtgagagagaatgcagattcctgtgggaataaaatcagatggcatagtttcaagagggcataggtggtgattcaagagaagtggtcaaagtggagctttaccagtgaaattcaaatgagaaaaaagggaagtgaaaatatcaaggaaacatttttctagaagcagctaatatcactagtttctcaattaaattttatcgtgccctgacttgttaatccagaatgaatgtttttattcaaatttttatttcctaatggacactgattgcctgaaagtttgccaagttgtgtttgcaaagctgtaaagtccacttacatactcagggaaaagaatcactacatttataaatgtagagtgcagagaggaaactatattgtacagtttttaaattactgttacctagattattaaaactctatgcacttagtttttaagtcactcacaaatttttgaaaaagacaactttccttctaaacagaggcatcttagcttttaaatcactcggaaatttttgaaaaagacaactttccttctaaacagaggaatccagtgacttgtaaatgttcagatgtgctgagaatgcttcttaaataaagacctagaggaaaaaccattgggaaatataaattacccaggcagattactaagttggaagctgagggacagagaggttaaagggttgaacatatgcttcccaattcttatgcagacttaataacatcaatgataacagctgctctttgtgttatataggcacaatggagctgaatgacaccttggttaatagcgccaacttgagtgctacattgcctgaatttaaaatccacctctgctctctgtatgtacctcttagatattttctgagaatttgatgagttaatgcatatagaatttttagaacagcatttggcacttaataggcattgacactactcccatctcttacatgtattactgatgacataatatatgtttatgctacgcattatacactctatgtatataatgtaatatttaatatgtatataatatttaaatttaatatactatagttatataacattgcatacaaattttataatttattataaataatagaaaatatacaaaaccaaaacatgtagaagttcaataaattatctttataattatgatttctaggctctagttattataatattggcatcactaatctttgagcatgccacctttctatatgtattatgtatgcatatatatatatatatacacacacacacgcatacatatatctatatttaagaggttggactcactctagcaaagacaaaacaaaagcctattatttttagtcagaaaaaaaaataaaagcctatgcttaacagatgaaggaaatttaaaaaaatagatggtaggttttagaaagatttgagacatgaaagacttgaaaagttcatttgccagtattgtgtggtctgtgctatctggcagtgtccttcctgtggacaagaccctgctacattaactatgcctattgcatttattgatcatatgacttgggcttaactctatccaagaaatgactgaactggctcctatcccaggcaaggtcaaagctttcaagcattaaacaccttttaacataatacggaggcttaaacccaaacaaaacggggaaatttgattcacatagtttttatacttttatgttccatagaagttggaatgattagacttgtgaatgttaattatttttccataccataaatgaaaagggcttaacccatttgttacagtacttttccaagaattaggggaattacgagttcagaatcaaatttttaatattttacaataagcagagtaatgattaaatggtttgttttttggatgaaactaggcatttggttttggaaacataaaatgaaagggaaagtcttgtttcctactactatacattgaagggaattcagaaagaaaaataaacacaagccattaataacataaaagcaaaaagtaaatacagaaatgacctaaatctaattttctttctgcttgaaaagttaaatagtcctagaaaaccgtctttggcttccacatttgaaaagataacatttctctaactttcaaagacatttttttttggcatggaacaatgtcaatcgaaaaaattactgtactacaatcctgttatacttgcaactcacacactgactacaagatgaataatttctgctcattggtttgtcactttcctttaataaccctagtttattttttcgtccataccatgcatatttgatgcttcggtttttgtgtaggttgccttgagattcttacccttgccaaaacttctggaaacattataatgagcaatgctttggctaagcctacccaggggtagcaccaaacttcctgtttacaatgtacagtctacatggaagggtgaaagtcttaacgatgaattttgctagcactttttataggattgagagaatgctgacaatttatttcaagatggaaaaaactgagattataggaaggtgagaatgaggtgggttataatgagaacatgaatcaacttacctaattttctaaaaataaacccttgcctgtgtagctcacatgtcacaccatgtgtttaccaccccatggggcaacaggttcatatttaaaattataaatgatacaatttcaattatcgttaacataaataatgatcctgcttaatcctctgattaaaagggtgtatcctagaattagattcctttgtttcaaagtcaatattcaatatttgctaagaatttgtatggggcaggttaactttctaaagtagggataatgggagtctctatctcatagggttgttgaaaagagtaaatgaaggagtgtatatatatatatatatatatatatatataaacatacatatatatactaagcatatatatatacactaagcatatatatatactaagcatatatatactaagcatatatatgtactaagcatatatatacactaagcatatatatagatatttagatatacatagcatatatagatatatatagcatatatagatatagacagcagatatataggtatattatatatctatatatagatctctatatatagatataaatatctatatatagacatatagttatatagtatatttagatacatactatactatactatatatactatatatatagttatatctagatatactatatatctagatatgtagttatatctagatatactatatatctagatatgtagttatatctagatatactatatatctagatatgtagttatatctagatatactatatatttagatatgtagttatatctagatatactatatatctagatatgtagttatatctagatatactatatatctagatatgtagttatatctagatatactgtatatatactatatactagttatatctagatatctagatataactatatatctagatatctagatatgtagttatatctagatataactatatatatagttatatctagatataggtatctatatctatagagatctatatatatctctatatatctatatatagtatatatatagtatagtatagtatacatctatatatagagatctatatctatctatatatagagatatatatgcttagaagaagactggcaaactgtaaatgctcaatacatttgagctattttgttaatcagcttgtaaattacttttgaggaaattcacacaatatttgttcttaccagtgctatgctatgcaattatactaagggattaaacactaaattttttacctgcaaaaatgtgtatgtatgtcagtctgaaatacccatctttattatagaacaatgttactacttgtaagagaatctatgattataatagggaaataataaaacaagagaatgaacatctaagtccagaagaaggccaggtctttctctcttcagctcagttatctccccttctcaccacactctgctagtatttcaataaaactaaatctaaatctaacaatagtcctgaccaggtaatattggaacttctccttcttctctctgaaaagccatggtggccattcagcagtgataaaatttgctccttatgggtacgtatgggtatgttactgctaacctgttcagattattattttttcttagcctaaatatcagaagttaattcagtaggtacttgacatttgtgaatataatattctaagttttatttatttaagaaaacccaaaaactccatcatatttaaaatccaccattttgtagaagcgtaagcttgaatcttgctttcctgatgaaaccaacccaggagccagccatggaaggagtaaattggattctccaacattctattttatgtaagcatgaaaagcaaacctattcaggattatgaattgaggtgggatctttttcttcacattaccaggcgcagtggttctgcaaatagcctgtgcaccatttgcatctcataatgtttcaaactagagtgtagttgtggttatatatgaactaaagtccatagaatgactaaagctgtatttgtactgcaccccttcccacagaccacatggtagtactgatgatgaagtcaaaaaaattctaaaattgtgaatattcttgatctgaaaactttgggaattatttttcgattcatttatatcacagaatcactatgagtctaaatggaagttcgcttagtatttttagttaattttatttttatagtcagattataagctctagtggaactgacaataatttagaggttctttcaggtcttgagtagtactgtaggtaaatgataaagcaaatgttttaactccacctcctactccagatcaaattctcacatacttcatctgctgtgtgtatggtgtgtgtttatgatgtgtgtgtgtgtgtgaattgaatttaagcttaagtgtgattttaggatatcttccttagaataagttatcttcatctcctcattcccagacttgccattgtatttcaatttttcatttgtttgcttctttaagccatgggattcaatgtaatcttgcacagaaatcaaacatgaaaaacagcaaaaccacacttctctggtagatggctgaggtagcaaagtacagaagagtgcctcctgcctgtcctccctcctgtgcccactccactcctacattttacccccttatagacaacatcaaaggtatctttcaagaagaaaattttgtcccagcaaaggggaaaaagaaaccatttagagctaacataaacaactattcattacggaaatcaagagagacagaggacagtggtaaaagggaaaatagaattgtatcagacctggactatagtccagacttcctgggttgccaattaagtggcatctggcaaactgggctccaggattcatttcctttgcctatcaaaggagactaacaatcaggaagactaagtaagttagactgatttactatgcactgcatggaagtgttgatattgccatcagcaggtcacttactcatttattccagcacatatctattgagacctactatgtgccagaaactatgctaggttccaggaaatcaaagataaaaggcacaatctctgccttttagaactctggtagtgagaaagtcatgtaaagttgcctgagggaatcagagaagattccaagagcattgcacaggccccagaggaaatggggataagagacaagtaatttaggtgggggcatgaggggaggacagttgttttatcctgtaagggcatgcggtcctcttgggaccctgggcttccagttaaaactcacagacactgaagagcaaggttcttgcctaatctcactctcttcagctgtctcacctcaaaacttcccatataccctgctttacacagaccatttctatcactatacttattgacagcattttataactatctgcataattgtctatcttcatcattacactagaaactgtttgctctatattcatgttcctaacaaatgcatgatatccacttaacagtattgaatgaaggcatagatggatgatttaatgaataaatggtggaagacagtatacaaaagagatgttacagcaggaagataatgtttgcttactccaaagtttaccttgggtcctgttcaacatactgatgaatccgatcctccaacccactcttttatgtaaatatggaaagcaaattctttcaagattatgaagtaagataggaaatgtttctcctatcctaacaggagcaataacttgcaaatagctatatctacccctccctctcctcacagtatttggctttggataatgtgtgttctctggattgttgggtctttggaagatggcttctctttcccatagactcacggtagacatgacctcaacatgtaatctgtacaaggcaaacatgtatgagcaaggggacatcctagggacaccagggaataaatgcaaaattttgtgtgaaagaaaaggtgtgtggattggggatttctgtacaatagggttttcatcctttatggacctgggaaacagagtatctctgggagaaaaaagttcaggcatctctatatatatttccagtttaacaagctcacaaatcaatctgattatccagcaattcaactgggatctggcttacatcttgtaaacaaacacttctggttttacctttttgggttctggcatattattaatataaatagtgtagattccacttttattaaaaccagcttgatatacatctgcacagtctctaaatggtttctcttcctctctttttcctccctttagtaaaactgcaaaaaaaaaaaaaaagattgcaatatgtgaatatcagtaccattagtagccaaactgactccaataatagctaagcatgtcttcatttcctccacacaaatgtcaatatcgcacatagtaaaaagtcaatcataaagacaatactagattttgaggtagcttacaaaattaaaaaaaaaaaactgaaggaaaaagctgtagagccatttttaactgaatgcttatattttacttaatttcttaattcttttttttctatgtatcctttccaaaacatcaacttaaggaacaaatgacctgggcatgtaatatcttcaattggtagcaattacgtcaagtttcctgcaaaatctctaaaacgttcttacctacatttcacaggaaagtctaaaaaaagtgctaacacactttttggagcaggaagacatgaagataaattcaaacataaaaatgcaatatggaagtttaaaacactaaaacaatggaagtactgtttttctgtgactttatattgaagagcttctagaaaattttaccaacaaaacaaagcaaaacaaaaagaatcaacaactcttaacaataattagatttgggaagtagaaaagagtttatgacccaacttaactacctacaatgaaaatgaaaccaaactttactttgttctttctttaatgccctaaagttaaatcatcaggcagatgatacacaaataaaagaacaaacaaataagactttgaaattaaattatacaggtgaaagagtcacagtaaacactagaagtcaagtgaagacagaaaatctattaatagttagagactgtctctactgaggaaaaccttattttatttactgagctttatccattattaacttcttacaaatgaaataaaaatgcaaaatgacccacatttaatagttcttagctaaagatatatgtgttatatttataaagtatttatgatttagtattttctattatgtattattttagtaattggttttatttaacctttttctagaaattaagattaagactattttgttatcttgcccttaaagtttcctatcaataaatatctgcattcaaacacattgagttataatagtcttttataataaaaataacaaaggcaaactatgaatcagaacttttacattaattttaaatgatctaaaaatctaaaatcctggcctaacttaatactggtttcatactaaatactggcctttagttgcctaatgtttactaacttataggtattgagcagtctaatctttatggaaataattactatttcaatataaattactcagatttttaaaaaatattaaattatatttcaagaaaatgaaatatttatgtcagatatgttgccacagcagaaaaatagtactaaagcatttaataacattatgattttctatgtagctcaagtctgcactaatggttttaatgaatcatactaataattacatctaaataccaccatcacaattgccatgtcaacacaaaataaatcaactaattaaagggctacagattcatatgatagtgaagaagtactgcacagaatgtatgcaaatagcaatttaaagatgcatatataaatgcttactcaaaagccatctttaatgacactgaggatgtcaatggattatataaaggtatccatttcaaaagcattgacgtagtttactggtattcgtttattctaactttacggactgctatttttctaaaacaaaaaaaaattttaaatcccacctactggatcctttattctgttggaaagttgaaaataagcaaatcagatgcccagaaaaagagatgtgaagaaataccaactaaaatttatgatcacttgagaggacaaaaaacacaggaagatgtggtcagcaggaacccaacggtaaacccatttttctcttttgagagagagaaagtcatttatctatggagaaaatgcttctcttgtatataccacatcctgccctcccttttttagttatgtatggagaacacattcccttcactcttgtctgccatctctcctcccatttttgctttttctttccacttcaggaagatgttggtgaagtggctatgtgtgggaagaggaagctatttcacacacatttttagtaaccgagaaaaaaggaaaaagttgggtattaacttatttttgtgaaaactaacagtataaatttgttgtcaaaaccatgaatacaaattctatacttgggaaaatggtttgagaattctaccatcaaaaggtacacctagtattatggttatattatggattttttgttgttatggtaacatatctgaaatagatattgtattttcttgaaatttaatttggtatgtttgaaaaattgagatacttatattctttcaaaaaagtcattctttccagaaagattagattgattgtttttaattacttaccaactagcaagcatatgcctgaaagttaatttaggctacactttagagtagcaaggcattgaaaatcattgtaaaagtttcatccacagcttacctttggtatttttattatatactacggtttgaataaggtccctttgataagggtagattgacctttagagttttttttgtccttaatctataaagtgaggtagttataaatacctctgagatgggtgtatgaattacctaacacagtgcaaagacagtgaagcataataagtactcaagaatggtagttgttatggtaatgacaacactgttaacagcaatattatcctgttactccttcttatggaagagacactagcagaatgtggaaggccagtctagggggtggtggatgctgctgtcttccaccttctaattaaaacatagcagttatagttgactagttatatttaggatcacattgaattagcctctcctggtcaaatttggctaattggctggtttcattcattgaataaatcagattataccattgtttacatttaagaaaaccccaaaacaggcaatctcatcttgctgtgtattttaagctttacctaaatagttaagatttaaagattatttcagatgaaattataaacgatttatatgtcaacatgttggttatagaagtttcaatctcatgactttttgcatgactcgtttctttgttaagtactgcagagttctgaagtccaatgtcatgcatagatattataaaactggacacctaggaaacattctaaaacctagagagacaataacatttgaatttcctgaacattgcaagtgtcagcaccagtgataagatttttaggaggtcttgagcttcagttagatagaagatagaaattggaggaatatttagtaaatgacacgagacagatagatacaatagacttgatggggccaagagcagtggctcaccctgtaataccagtgttttgggaggtagaggcaggaggatcccttgaggccaggagttcaagaccaacctgggcagtacagtgagaccatgtctcttcaaaaattaaaaattaaaaaaaaaagtctggactaagatttgatggaagagtaaaagaagcatcaccgaacagatgtcagggggaaccttccggagacctgaaagagggctgtatctatctctcaaagtggtttacactttttgtaataatgaactgatttgaagcacgagttaaaaggttgatctttatgtctaaaattctttctttgaccagatattcttatttttcctttcttattctttaatttctgatgagttcatcttccctctcattgagaatttagatccctgccattcctatcactgctttccgagcctcccttttctttcttcttagcctcgatcccagagtcaggaatttaataatggtccatttggcatccctggtctctccacccattgtcctttcatccactcacctttgcataggtaaatcccaacccccagatgggcattcattcactttctcaacccccttgtagactgcaaacactgagtcatttgtaataaacttcctacgacatttcctgtagagtgtattgcaaatctttctactgttttaaaaaactacatcttatcttctctcactctttataaatgacctttatggtttactctgaagatcaaagccatttgatatgtctcctccactcccttcctctaccctatagaagttgtctttgcctatctttcccctcgcgttttttgttgacctctcctagtccctttcaacttctccaattgttttttctctttcctcttttatcggtttattttcctctcatcacctaccatatagatgttcactaagtttccattcttggatctctatttcttatatatctgttcattttgcaaactatctatcatggcttccaactgcggcacaaaagatttctaatatacacaggcactttttaacactgagtatttgcctctctctttaccttcagattcatatatctacttgcctgttgggcagtccttcctgctacaccaactttcatttgtttaatgttccataatctttccttccaaaccaggtgtttgctctttcccttattagtcccactatccttctccagtttttatcagttaaaaattaattaaagtgttaatttttttctaataagacaattagagtatggcttttccatttgtccctctgcttcttatcctctcttagttcaatcatcctatattattatttcaacaaatattgatggacatttgctatttttaagacttctcctaggcaatggagatacagacataagaaagcccaagcctgcctgtcatgtgatcacagcctgatgcgaaaaagatcttccatgaacgctatacccatgattagtaacttttatgataggacaaaactcaattcaaggtggcttaagcaaaaagataatttattggatcatgtaactaaagaatccaatgtagtactttaagtaagtcatggtaaggtttcaaacaatgtgaccagaaattggtttcttagtctttttcttgacccacttattcttggcaatcaacctggtcacaagatagctggcaataacttgtaaggctataatgtcaccagtttaaatacagcaccaaagagagagaatgcagacaattgttatcttagaggtatgtatcaagcacattgggaacatgcaagaatatactccttctgccaggtggacaccaggaaggctacctagaagagataacagttgaaagaatataacatatagaaaagcttatctgacctaaatttaagagcctggtatgctagttcaaagactttgcccacaccaatatcagcaaataaatctagaaagtcctaggaaggaatcattattcattcttttcatttagccttatctatacaaccaaatctttgtcatctaaagggatagaatagagacacaaacaggtgcatgtctgtctttcaccagccaacattcagtcaataagcaacctgagaccctgatgctagcagctgttgactttatcctgatcttcccttcctttacccaaccaatttaaatctagatggtgcatccaccaccagactgacttcaggggaggaccatgaaatctaaggcagagggtcacttcaattcagatgaaccctcaagaaaaaacttcctggaatgtggaattggtaattattagcctcagcaacactagccgagaacacagaaggcaattagccttgctaccagagacagtgtaaaaagccaaagccctttctcttacccattttctgatgagttgctataaagaaatcagttcttcaatcgttcattttaaaccttaaatatggctaatggttcatgtatttccagtatttaccgaacatcagaatacatgtggatcaggttatttgttcaaggatagtccttgagacatcattattaggaagatcatagcactagaaattgaccctgaacctgtgatttcaacacaacaggtcactgaaattaactgagcatataaaggaagaaaacagcacatctgacaaggtgcaaacaagcaaacaattgatggattagattttgtgcttttcagccaggtgtgtgggcatttcatagagaaaacattttgaagacactctctggaatcctaatttattcaaaagaatctttaaaagtggaagaaggtaatgtcttgcatttcaagggtgtggaagaattaaaagatttccaggcagtccaagtttcaatattttatgggtaggtataggggtgagggatatttaccaatgactttataaacagatatacaaatatatatagctacacaaatacatacaagctgtatgcttataaatggaaaatgttgaggttggtatttttttcttgtagaaagcatatgcatacaaacctaaatatctgtgggctgatatctcagcatgactgtttttaacctacaaaaatggcaattgaatatggttatatgtgtgtgtgcatgtgtgtatgtgtgtgagacagtataacaaacacatacattctattcttaaatactcttaatttgaagtctttgattaactaaaagtgtacttttttatttaaaacaactacttcttttctcaaagtccctctaaccctggaataagggaacacttgaacatcatttatctagtgaattattattttaattaaacatttttaaaaaagaacttctttgctctcatttaaattatttatatgtaattttatagataatctataaaatcttaactaccattttttatggaactataataatcatgatcataataaaatcaactagcattaattgaacacttactatgtggtaaactctgaattttgtgtgccaagtatgttttacatgcttcattttgttcaatccttataaatttcttatgaggagtatttatcaatatattgctttacatgggaagttgaagctcagaaatgctactaacttcaccaaaacttgtaagtagtagaactctctgactataaagctgaaaatcttaactacttcttactggcctttgagtaaagtgaaacccaaatagaacttcagtgagtcatctgtcacagaatccccagcaatacttatctctgctgacaagagcacacccaaggtcctgagttattcagtataagccataagtctgaaagggtacagcctcatctcatggaagcaggttgtatgggaaaagagagaggaggcagcaatgataagaacaaagaatatgttgacatgaggatagcagagagccacaggcagtagaattgtctgagatgaaaaccctcagcagaaaagtgaagccgtgacagcccacaatgtcaagagctaacagaggataagtgagaggtcccaaagcagccatattggattttatcatgttcatacccttaaagtcacactgactcaggatttacccctattaattttaggtattattctcataagcctggtagttggtctcccagcctacggactatttgctagaagcttcaaagacagagaggataggctggcggggtagtgagagtgggaatatgtgtgtgtgtgtatgtgttagtgtgagtgtgtgtgtgtgtatgtatgtgtgtgtgtatgagtgtgtatgtgagtgtgtgtgtatgtgtgtgactgtgtgtatgtatgtgagtgtgtgtgagtgtgtgtgtgttcatcttctagtatcaggcatggagacaagaaattggatcattgaaagtatgtgtgtgtgtgtctgtgttcatcttctagtatcaggcatggagacaaggaattggatcattgaaagtacgtgtgtatgtgtgtgaggaaaagacagaaaattttaaaaagtaggcaaaactaagaaatgataagaatttgggcactgaacaatataaagggggcatgctatatacttttccagaggcatcacggtattatgatgaaaattaattcatatggataataacggattaaattattagaaaaaaagccataattttattcaattttctcttccaaaaaaagaaaggagaggataaaaaatgcaggtaatttttcatcacatttaaaaattttcataaaattttactaaagggatacattttaattatctgaagaatatattgcccatgatatataattgcagatatacaaattttcaataatactacgatatacataagacatacaaactcttacatttatgtagagatgcaaagcatcctatgtcataagtgtagctctaatttaaagtctgttttaaagtggaagaataattaaatatcaattctacatatttgtactgtagtttgattaccatgttcaaataaattttgcaattatcttccaatgtgaaacgaatctcatgtgtataacaacgtatattcaatgcctattactacctaaagtaatcaagaatggggaaaaagctgggtgcggtggctcacgcctgtaatcccagcactctggaagtccgaggcgggcggatcacaaggtcaggagatggagaccatcctggctaaaatggtgaaaccccgtctctactaaaaatacaaaaaattaggtgggcgtggtggcgggcgcctgtagtcccagctactcgggaggctgaggcaggagaatggagtgaacctgggaggcggagcttgcagtgagcagagatcgcaccactgcactccagcctgggcgacagagcgagactccgtttcaaaaaaaaaaaaaaaaaaagaatggggaaaaatacttgactaaaaggtacaactggaaatacacaccatctttgtttaatcaagtaatctttcattttacataaaattaatttctttgttttccctttgggcaccctgttgggcagttacgaatgctgcacggcccttgccatttgttcaggagctcattttattcacaaagacatttcaggtgtttcgtgtgtgttaatttcccatatactttttttcagcctggctaaaatatattggttttgtacaaaagatttcccatacatgtgggaaagcttaaggggcatcttttgtgctctgctatgagcagacaaatataatttatttcagcaacagccattaaaaatggaatgaaagtccttgggcaatgctgtaaacatagaaagcagttgccagatgtttttgaaaactgacacatacacaaaattccactttgaagttttaagtaaataagtcctgactgtcaccacaagtacgtcaccttgattcttactcttgtggtgtgatatacttaaagaacagtacttgactaccagccctggctctacatgggcttctcctctgaatacagggcttcaccggttattaggagtgacacaaaaccaagagacaaagttggaatgcttgatatgagtcataaagtatgtaggtttgtgtaggataccaggcaaactctaaggtgtgccatacttctatgttaagcaatctgacagcagagctgggactagaacagagatgtcatgattcctgctccttctaaaccaccatgcctgccctctcgatggtatacacctgctcccagatactggagagaaaccatctcaatctataattcctagctctagagagataggttggataattaattatgattaagattaggtttgtgcgtgtctgtgtgtccatgaggcctaaacaactggcaaaatctccctttagaaccaaatttccacttaaaattatacccaaagttcaaactcactattctaaaggacgtcatcccacttgtgaaaatggaacgttcacacctaaaaataattaagataattaagatacatgcaaacatataataaatacacaagttaaaagaggtctgacatttgatattacatttgataatctgacttattcataaatccattaaaaagatgagtaattctttgtaggctgcatattaatatgactccttagcagacataaccccactcagaatgtgaacacccaaactagcacaagcatgagattccagtgtacttaaagttagttttcatgttgatatcctttggttgataataaattatgagttcctataggaagctaaaaatgttactagttgttttttttttttttttttttttttttttgagacagagtcttgctctgtcgcccaggctggagtgcagcggcgcaatctcaactcactgcaagctccacctcccaggtttctgccattctcctgcctcagcctcccgagtagttgggactacaggcgcccaccaccactcctggctaattttttttttgtatttttagtagagatgggatttcactgtgttagccaggatggtctcgatctcctgacctcgtgatccacctgcctcggcctcccaaagtgctgggactacaggcgtgagccaccacgactggccaaaatgttactagttttaaagattctttgcaattgacttttagaaaatcttatgctaaaaataaatatttgtttatacacatttaaagctaagtgtacagttgcaacattccccagattttaccttctttttctcccttcttacagtataaaaaatttcatgaggtcttcactctatagttgatatgatgcatacatatttaatgctgttaataaaacattttttcttactgtctctcagagtaattataggtgtcatttggttcagtgtaaagtgccatatcttatccgtgactaatgtctactgttctgttttgtccctggtttagaaaatatctgttgaatttgacttgagtgtggatgagaccaggaaatgacttaattgaaagtctattcaaactatctgtgctccttcgctttagccaaccaggctatgaaagcataagggaagaaggatggagtttgctcatggtaatattggaacatcaaggaaacactctttttgtggccttttacccctgtaacttccaagcccagctggaaccaggagatatcccttttcagatagttcatcttgtttctgaagttaaaaactccaattccaaaagagaattaaccacaaaatttcaaatctcctccgaaagatggggtttagaaatagttcatgggagaggtcaaggactatgttattttttattttgttatcattaatttggctatccactattcacaattttttttacagaaattatgactattctaaaaggcagataacacgctccatcaaaaaggagaaatataccatttccaaaaataaacagtcaattttgccttaagccactgggttttatgaaaggaagtgctagatagtgtggttcattttaaggaaattgtaaatgtttgacatataattttctgtcaagataaagcatttccctcattaaatggaaacaagtactcactgcagtgttcagcagatgacttcctgtatttttctttctctttctacctaatcttaaattgtgcactacaagtagtaaatgaaaaaccaagtattttacccagtcaacgaaactgatatattccatttttatcaatgtttatatgactgacattcaaaaagttttaatttcctcccatcacttgtgatgtttttagagtcattcttaactcaagggacttgcagttcaaactatctcatcccttacagaatgatataaacttcataaactcaacagacacaacatgggaggtaaattcctttcagatggtagaattattctgagaatcaagccaaatgactcctcagcactgagaagaaagcaaatgcctcatttccccctttaagaagactagaggacccataataatgatcaaatgttccataccactgcaatcagcttctgggaaaggcactttagctcaaatagtggtcacttaaacatttgtagtatcagccattatgtctctgtgataatgtgaaatgattcttaaaaatgaacttcatgagaagctcctatgagttgaaatttgaacttcttatgagagaattaagtatataaacatgttcttgtctctcagtacttatttttaagtttcctctactccgtgtgcctccctacttaaagttgttatctgtcctttcacattcaagtttcttgaatgcaggtatataatgatttctgttaacttcctctcactcattttagtctctgagatatgcaactgagccatgtagcataccaaacctctgcatacagaaggttctttttaaaaacttgactgtcatgcttacttgccactgaaaagaacatccttcataactgtcctttttttttaaaccttcccaaaacactgcttactactgtttttcacactgtctatatttttctttcggtctcttttttttaacctgtcccttaaaaaccttcaaatttttctgtctttgattttacactgtcattttttcatacaatgcactcataactttggtatgtaaatgctctcaaattgtacacaaatgtgtgcttatatccttgcattttggggttggggtaagtggaaaggaaaaatagccgtttgcatctggtttcctgatggatctgtgacccctacatgaataagagccattgctttatatgcactttctatgattttacctcttgtctcctctgaggacaaatcattgttctccttctagaatccgatttatctgcctgccagactctgtcccacaggcaactcagtcaaaatatcccaaactaaaactcactattttttcccttccaatctatttcatctcccatgttgctggttttaaagaatgtgatctatgctccctcagttgtttaacctagaaatgtgcaattggtattagattagacttctaggaagtcattatttcttgctgattctaatttttctatttttacaaatttcttccacttacttttccatttacccctgtttaatatggaccttactatttctttcctagagatcactttgaaattctgacaaaaatcatcaactctaccttccctgtccaatatggtgcagcgtgtaatgtacagtattcagaacaagactctgggttcaaatctcagcttgctcacttgctagtagtgtgatatttaagcattattcacctctctgtgcttagcttacctttcatatagagttggtaatagaacctatcatacagtgttgttaccagaattaaataaactaatatatgcaaaggtctcagaagactggcttgtgtcaagtatttgctgatattataataacggtaaaagcacccatctggtcccctactccaggcttctcagctttacagtatatttttcctacattgtcactggggagatttttgtaaaacacaaatatcaccattatcatcatatattgacaatgactgctcattgattttatagaaaaaatgtggcctttttggtctccctcagagatcctctctctaaattcattttaagacttaggctacagcccgctcccatgacttctggaaaataaacatgccgtttgtactctctggtgtgtccttcactttcttcattttttagacttaactatcatcttcccactagaacaagcttgcttatattttaatcctagatcaatgatttccagctttgtaactttgggcaaattctcaaattctctgtagaggttataaaattatgctagacatggtaactccctcatgttgctgttgtaagggctaacacgtggaaagcctaagcaaactagaatcataataaggattcagtaaaatccccaagaaaactctagagatgctggattctgcccttatccttctgttcctgccatgattttaatatttctctgtgagctttgctcgggtccaggcaccctaggctcacttctagcaaataattctgaaaaataattgtttacttttttctctcctatcaaaccctaggttccttaaagccacagaatgaaatacatcttttcttcttcccagtagtctgagcaatatttggcacattatagaaacttaccaaatatttgttaaataaaaatgaataaatatcatttccccagaacagaacagttgctgcagaactgttttgaatgaatggataaatttatgaaccacatcctgctacagcagaaatgagcttcgagctgatttgagcagtgtgagacaatcagactatgtaagtttataatacagtctaaatactttttttaaaaactttttcttttcttttttccttccttcctttttttacatgctgttagtaattaaattcccaattatatatttgccacgtgtatgctcaacatgagatgacattttaatcaccagtgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctcagcctcctgagtagctgggattacaggcatgtgccaccatgcccagctaatttctgtatttttagtagagatggggtttcaccatattggccaagctggtcttgaacttctgacctcaagtgatccacccactttggcctcccaaagttctgggattacaggcatgagccaccgcgcctggccaactagtggttttttaatagtcacagtaactgattactctcccctgaaagattccaaaccttgtttgtatgccttattaatgtaaattacttaattccagcaaatatttaattttggtaattttgaattgccaaaaacatgaagcaataggctgagctttgacattgtgataacactgagggcaatatttctttagtggataatgtttctaagaataaatgtggcccaatgtttgcagatgaaggttaggcaaaaataaatgtgttactcagaagccttacaaagtggatgcaattcagtttgaattgactatttgcctaagacaccattattgtctattaggaataagaagaggaaagtttggtgaattatttcagataatgtgtttattagttgtccttcttaaaagtatctcacaacatcagatgtgttagtagaaaaagtgctgtgaaactaaacaaaagcactctctgaatgcaaagatagatttacagtttctggatcaaacaaatgtttgggaaaaaaagtacatgtctagccaacacttcctaggaattctttatcatataactttaatgcattataggcattttagaaggcactaaaataaagataattacgattattttaatgttgactatgacttaacacagaagctatgcgttttatactaacctcttttaatatttcaacatttaagaaattaattcatttacttgtttatgtatgtatttattctaggccctctatttcttttttaaatttgaattttttaatgacaaataataactgtatatatttttggagtaaaacgtgatgttttggtacatgtatacactgcagaatgatcaagctaattaacatatccattacctcacatactcgtcatttctttgtggtcagaacatttacaatccacttttttggcaattttgaactacataattgacaaaagttgtatatatttatggtgtactacatacctaccgggtagatattatgatcccattttagagatcagaaaatggaggccaaaaaagctgcctggatgactgtcaacactcaaacactccggggcattgtatttaaacattttctgcagaggaagttttgcttataaagcacataatgaatgtacttaactgaatcttgtccatcgaaggagaaagaagaaactaaagtttaatgaatcaactgtgtcttcagcaatgggatcttcgcttgtatattgagcatctaatgtaattctttccctattgtggtgaaatagacagaattctcctgactttatacatgatgagacagcttccttaaggttaaactggttgccaatgacaggggaagctcattaacatttttttagtctggccttgcagtattatattcaggctgtctccacagattagtgggtcagattgaaaccagaagaccttttagggtcaattaaaatgtttggctttttggatgacgacacagctcgtgttttttaagatcttgtagaatacctatatttgagctttaaaatgtacattttagaatatttgatgcgtttattctggtatgcttattttgaaatatttgcatatatataaatttataagtaaaatatttacatataatccttcaataaataataaatttatatgatatataaattttggtcataaaacaaagaaaggctttacccatgtgttttagaatttgaataaaagttcattttaataactgatattcaatctagtattatgctattagccatttaaaattttaaattcaccatagccaacgactaaggctccagtgaaaataaagatatgcagacaatgaaaatcttcataaaaaccttatgagagccactttccacttttgtgtctcttatgagttctaaaagtaactaaatatttagttagaacgcttaacagtaagattaaagaaaaaagagattaacaagaagcaaataaaatctatggtcatgacagcagagaacctattggaaaattaggcaatcaccttaaattaagatggcaaatcctgtagttaaatcaagattcatttcagagttttgtcattaaaaagaaaagatatctagaggcctggaatatttagacaaattcagtttctatgattattattactatttttggatatactacatcatagaacagacacagttacttttttcacttcctgaatggctatgaagggtaccatctatcatggctatcctcatttttcaaaaatgtttcttaaattgaacagatgtttgcttccctgatattgcgcccaaagttgaaacctagccagaatgtttacttctaaagtcacatcctcttcctctaaaagcttaaagacacatttattaggcaaatactcagaaaagaagttaaattatgataagtacgcagacatatgagctctgtgagaatcactagggcttgacatccctaaaatcatgaaataaaaaccactattccactccatgtgctttaagtcttaggatgataagaaaaatgtgttttcaatctttcccaaaatgtattcagctcaatatgagaatagatataacttgtattaatacttaatcgttaaatactcatgagttctattaaaattctctggcaaaatactaccatgctttccttccagtggactctaactcaagattttggcagagtctgactgattagcaggcttttcccttcccaaccacattactgagcacacccaaatggagctctgggaactcactgtttaaaaaatattactttacaaagcatattaaaggcttgtttagactatctaaaggagatataactcgaggtaatggagtgtaatagagaaatatgaaatgtctttaaaacaaaatcacttaatatggagttatcttccctattcataactatagatgaaagcatgaaattgaacaaatttgtcacatagctcaaatccacttttaaattaaaggagcctccccatgtgtacattgcatatgctcactgaaccacttcatgaatggtcacataagccacagcttaataacaacaacttgcagatgtaagtggtattctctttcactcatcaccatttacaattccatcttcattcagagaaaggctgattagagaaatacagaagatgacttcaagttccaaactttgaagagctctactgaggctcactagaggttctgcttgaaggaaacaggtgcaagcagaggcattcattcaataattgttaggtggatggatggatagacagatgtatgccttctaaagaaatacagggttgtagatattcccaaaggttcaatgactccagacattctagtgatatcaaaaatttgtatctccactgtcacaaagataccccagaattaatgaacttaaataccctgattaaatctatcctgcacaggactaagcacaagtgatcttaataaacatttttaataacaataatcctgcctcactcataatacttgtttcaaatagtctgtctccgtttctctgcaacccacaatttcctaccccattccctttaaaaggaaataataaatattcatttaaaaatggaaatcctcctgaaactctcccagcactatgaactaatttttaacattggctcatctctgtcctatatatagttaagtgtctaacaccataataccaattatttattcacgacagtatcacagattttatctaaggttaaaagacaaagaaagaagaaattagaaagctctttcagaaagacattgtggattcacaaatttaggcttatgaatacattctccaggtagaaacatgagaaaattatcaacataacttcataaatgattctaaccataaagttcttctgctattttttacacagcaatcaatgcactgtagaaagctatattgagtatttacttgatcaaaggaaataaaatattaacaataccaaagtgaggaagacattcttaccaccttctttagtgcaaagattgacaaggttgtggactgtgtccatcagctccagttgctgcttctgaaggacactgttgttggtggtagctctgtttaattgcttttccagctcctggattatatatgtttgacgagtaaccaagccttgaaggttctctttctcttcctttaaggtgtccaactcttccttgtgttttccttccatttctaagattttatgttctaataaactacaaggaagtgaaaataaaacttagatttgaaaaaatgttatacaaaaaaacccttataattcaattggttcctgaatttatttaagatgagaaattttacatttcactgtaaaaatatttttaagtgagagacttaagaatatgtattcttcagaataggagttacacatataacatgtcaaataaaaaataagtaaaccagatattgtcagagtaatgtttgcttttaactatgatttagtttcttggtttccttgggtgtatcttatatccaaggtagctaacttacacccaaatagctacactctaaagaagttatagtataactttcactaaagaaatgggcctaagaggaaacagaatagttcaggaaaaaaacaaacaacacgtagaaactactttttattcactttgcttcatttatttggggttttcaaaacgttaacattgactaaatttcacgatagttctgtgggatcaagaatagtatattgaccatctgcaaaatcagaaataaagagaaaaatatgaaataatcagaaacacaaaggtttatgtacaatgacattaagaaagaaaaaaatctcttattttgaaactgttgaaaatatttttaatcattttaaggatattagaaaatgctcaaaatatgttaggtgaaaaaagaaaaaacagcaatatacattctcaatcacacacacatacaaaaagaaaactatattgacacagaaaccacaggagccaaaagtgatctatctaaagtcacaatgaattcttgtgatttttgataactggtcctgtatcataaccactagcttcctttatttctcaactcaagcttcaggatgaggcttaatgacactacaagttcccaagtcactgtataaatggtaacaaaaggaagactccctttggctgatggtatggtcttctgaaaggagttgggatgctttgctcagagtgttgaaatctttaactgaggcccttccttctccctgagctctttataggatattccccttgtatattgcacattaaaaatgatagagaaagcagaagcatttttggagcctaccaactgactggaaataaaaagcattaacattttatggagtgtctaatatactagttttcctccggggaaaggcttactcggttttctcagttctgttttcagaaggttcaacccgtccttagtttacaaggtgttattaaaatgccacataccagaatgggcacttaatttaccttggagaaatacagcactgaatcattcctttcaaaaaggggacactagggagtgttttagattcaatacttaaattataaaatagagcatgtttgaagagccaaatcttccaacaccaggtactgggggacaaagtgtaacatctgattgtcttttacacagattaagaagtgtgggtccaaggcttaaatggcataaaagactgtgagggaatcgagagaagtccatgtggcagaagctgtgccatcctggtagatgccagaaaccttgtggatggatcagcatggtagatggtgatgatgatgtcaatcatactagtcatgatacctctcatttatgacatggttgctatgtgtcaggtactgtttttttgttttgctttttgttgttgttgtttgtttgttttaagacagagtcttgctctgtcgcccaggctggagcacagtggcgtgatcttggctcaatctctactcactgcaagttccgcctcctgggttcacgccattctcctgcctcagcctcccgagtagttgggactacaggcgcctgccaccatgcccagctaattttttgtatttttagtagagatggggttttgccgtgttggccaggatggtctcgatctcctgaccttgtgatctgcccgcctcggcctcccaaagtgctgggattacaggcatgagccactgtgcccggccagtgtcaggtactgttttaagtggttgttacgagttcaattatggcctgcccatgcttgccccccagccaaaaaaaaaaaatatgtatatatatatatgtgtgtgtgtgtatatatgtatatatatgtatatatatatgtgtgtgtgtgtgtgtgtgtgaagtcccaacctccaggaagtcaagaatgtggccttatttagaaacagattcgttgcagatgtaattagttaagatgaggtcatcctggaggaggatgagcttctaatccactatgattggtgtccttataaaaagggaaaatgttgagagacagatcagatgtgcacacagggaaaaggttgtgtaaagattggagcactgctgcctcaagccaaggaactactggcaggtaggagagaggcctggaaccgagtcttccctagggccttcggagagagcctagccctgcaggcaccttgatccttgatctgggactttcagcctccagaatattcagagaatacatttccattgtttagaagaagaggaagaggaaaaagaagtgtggccagaactactcctgggcattccaaatctttgccaacaaacttgtactcgaagaatatggcaggaaagctgcctgtgaagtcaagcctgaaaaatacctgaggctgctaagactctactaatttataatacctttagtagtgtgcacacattcacataagaaagtttctcattgagacccattagcagaaactgtgtgacttctgcagtagaagtcccatttctgttttgaattgctttcattctaccaataccaagagagaaaggagccctgccctgcaccgatcataaagtaaacccaatttagatagagcttgggtacagtaatatagggaaactgtgatgatcacttattttttaaaaattcttttggaaatgaaaaacttaggcaaggtaagcagtgtaagatgaaaaacaacatctgtaaggggtaggtatgattcatcttcttttaccatgttatttttctttgccagtaactttttgttggagaagttcgtggtaaaacacaaacaaaaacaaaaaacttcttcactatctttattggttaaaagtttcatcccacctactggggtaggcgtcaaaggagatcttctctgtgcccattaatttttggcctttagatctgagaattaaccacgaccagtgtcttagcttattctctgtttactttttatttacttttcttgctagtcctggggtaatgatcagaggcaagatgcccataatttagagttgttaacttataagaaaattgccttttaaattcataggcgttatagtctactagtgagaaaacttagcattacctattaaactggcaagcatgtagatatcaaaatttgaacgttatagtcatataatactggataaaaattctgaattaccattttgtacttgaaataagatgggcactggcctttcagttttcctaatcagtaggtaacattctggtttggaaaatatcatgctatagttataatttgtatttattagttgctaagtgccaataattctgtaaaatataaaatgacactattcttactctagggtttatttttagagaataaaaacctcaaatgaaaatgcagaagctaaaagaaacttctgtttcagacataatactttttttttaaatttttgcatcagtgtttttctgtttatttttgatgtattccttgttcaagcggacatatgcgcagagatagctgctatctgagatgtcagtaaagaaggtgggcttgtttgatttgttttgtttttcaggataacttggaaagagctgagaatggaaagtagatcaaagaagtcctggtactaaaggaaacaattctggacactggcttgtggaaaagatctgcttttctgagtaaaaggaatacataatatgtataatatataatataacgcacattagcacgttagacagaacattaattttcataattcatcagacaacctttaatgctcccttactagcaggtatcaaaagatacccatatagtttgtcatcttagaatagacagtgcatgtaatgtgaaaaagagactgtccatggaactaagaaggctactctacagcacagacattccacaggatttggaaacccaagtaatatgcataacaactacaagcaaattggaaacatgttacattgtttctctaatggcaagtcttaccagttaattatctcttctcatcattttctcatcacatttcttcacttggagcgcccttaataacatttgtacttcagtaattatctaccaactttatttattagggacatttttcatattaatgacaactttttagacttcttcaggcaagactgatctcttcttgacccttccatttcttttgactacactcatccccttttttcatcttctcttcatatttggcttccaaaagactgctctcttctctttgattcctcccatttattggctagtatctactttggaagtcagcccttccttgtcattacttccaaaatggtttcaatgcaaacctcacttgccagaaaactccatataccatctctacttattatcttattcttgtaacacaccattatagttatatagcaatttgaaacctttatctcctttgattcttaaagcaatatagtaacatagaatgagcagatgttacagaccctcatggataggtaagaatcaaatgttttcttcaaaatcatgcagatattaagtgtcagaaccaggaataaaaagccatgtcttctaagttgttagactggaaatctactcaagacatcccactgctgtgtcaatgaacatcctatagtctcatctctttgacttaacacactataatctcttcctattccttttattcatcatgttataccaggaaccaaggcactgccttcacatatccttaatatttgctgctctccatttagttgttctgggagcttatccttcacaatatttgaacctgtttatctttcccacgtataaaaacagaattactttgtcaagtcgatttttaacatctggactagaattttcttaaatactaccctgtcttaatacctcttccattaaatttatgtgttaattttaattatattgttaatatactgctcatatttcattttgtccctgaagcctttcattgattctttactattttcgttatccaggtccgttgggagtggccacctcagctagcatggggatctttatatagagaggttgatatgaaggacaacactgcagccccagtgtcctaaagttagatagtcaaagtagtcagattttccctgatgacagtctcagctacatgtttagcttaggtttgcattttaaacacaaaacctggatggttactgaacaccagtgcactgtttcctagagcatattcagtatgttctttgaagcaaaataagagtttcattgttaagatttagggaggcctatattaaacaaacagtttttattaagatgcttcttttaggattagggttccatggaacaacactttatgaaaccatgcacctaaatctatacaaattgagctagaaatccaaggagagagtttctcacaggagtcttaggacttcctgtttcccgtctttctggaaacactttgagaagagacatgcatagaattctggcacttagcttctatttgaggcagaggtgcactttaatgaataaaataaacaaaataatctgtgcctcgaactttagtaaaaggttctaaatgagtgtacagcaagtcctatttgaagtttctggtagacttctccatacccctgttttacactgccttctccaacatcttattggaaatatttcaaatcattgaacatatcttgaagctttcacagaaaaggatatccctttcaaattgtttcccacaatagagttcttaacatagcagccaatgaattcacagtggtgacagttgcctaagctctatgagtataaatatagcccttcaaacaaggaggaagatgttgaaaatatagaaacctcatttttatctgtctgaatctatttacagatgttccaatattttccactattttcaacatgtatggtgtcaacatgtgttgcaaatatgggtttgtaaagagtaatttttctccccatttaaatacacacagatttagttcaggttaaatttatactttacgtgtctaattggaatgcaataaatttcctctcaaagtctgaaatcatatttgtttggaaattcaaatttggagtagaagcatagatactataagtaaatattggcaaataaatgtaaagtttggggtaaagaagaataagctaaatgtattataaaaaccagcaactaagaaaaaaaaagattgatacatttcataacacagagatgtaatgtttctattaaaaaataagttggacaataaataataaactagagaaaattttgtaacatatattacaaagttttaatatccattaaagagctcatatgagttaatttaaaaaaggataaacaatatagtagaaaaaatgttaaacatacgtaaataggctagtatgtagtcacagaaaaagaaatctagtcacagaagaaatgcaaatggttaatacacacaaaaacatgcacaacttaacttctgaagaagccgagattaattagatggctagcaaagttttgggaaatttgaaagcccaggtactcttagggagaaggtaaaatgtgaagataacttgtgaatatctataaaaaatttaaattatcacatcactaattatagttttgataaattatatatctattaacataaataatacttataataggttataaattatagtgcatctataaaaatagattgctactcattcttgaaaatgaatgaggtatatctgtttatggttatatgtgtaatatatgtatgacaaattattatgaaataaatagtagaaaaaaccccaatgataaaataatctacacatatatgcacatatcatataaacaagtacttgtgcatgtgtgcaattatatatgagtgtacatctgtgtaaacacacacataaatatgcacactctatatatacacatatgttagtatgtttagagaaaacatctggaagagtaagcactgaatttaatctcttaatgatgattctctgctagcaggtggtatggtgtaggggtgtggaattaggggaaatttgacttacaactgtatatgcatgtatataatttaatatacatgtatatacaacaagtttgtcttacttgtttttatttatcatagaaatggaggaaacagtcataggtctagaatggcctgtgcaaatgctatccagaaattttaaaggtgggctgaattagtgaacctcagagtatacaatagtaacattgagtgccatgcaatgggcttttgacaatgcagaatagtggtgtaaacacgatctctattttattcatgttgaaaacgataaatggatttacagtatttaatgtaaacaatatgatttgttttttccactataagtatttttattagttgtgtgtgtgtgtgagtctttgtgtgtgtgtgagtctctgtgtgtcgtatggataaatggcatttgttgggttagagctattgggacatttcccagttccttattcatttagcattcaaaatgcatttaatactaaatatgcttatgtgtagaaaattgtgcccgggagcaggaagacaatgaaaataaaacacattctctgtgtcctagaaggtcacagcctaatagtatggatatagataaataaacatgcacacacagaaacatacatatattataatgtgatcagataagtgaaattatggggaggaaacaggtacagggctatcacataggtcataatgagcaaatctatctggtagagccagagacggactgttagagaagctgacacatgcaatgagtttccaaggatgaacagaaatttgtgagttgaataaggaatgtcaggcaaacatcaaatatgtctgaaataacatcatgtgttcagtgtcatactaacaactaacatgattaaacactgctgctcatgtcaggcactgttctcagtgatttacacacattaactcaatcttcatcttaacttcatacagtacaattattgtcattgttatgttacaaattaggaaaccaaaacacatagagtctatgtaagttgcacaaagtcacacaaataatatgtgacttagtcgattatcccaggaatcaaggaaaagtgaaaccaggcagtctggcctcagagctcatgctcttaactattagcgtgtatcctctaaaaaataagattattggaagtaagtctgcaaaagtaagattatagtgatcatggactgtattgtgtgctaaagaacttgaactctcttctatcagttatagagaattgtcatttggttgagagggaattaatagaggaaaatagtctgacttgcattttagaaagaagactttggcacagcttctggataaggactggagtggcacatagcttaaacccagaggtcactgcagtggcctagacaagaattcatggcagcttgacctaagacatagtcagtgggaatggaaaggatgggacggattagaaaaatatttagaagatggaattgatagcatcaacagtgactggtgagttgtgggggattagggaaagagaagaattaagatgagccttagatttccaatttgatcagaattgtatttcatgccaagatactacggttattataatttaaaaaaaggaaaatgctatatgctattaaatattattttaaaaattaacagggaaaaaaggtaacattctagtatgtaggtgttctatttacaagaaaaagactagaataatataaattcaaaaagtcaccttttttatccttgttataaacaactaatataattcagcctagtttaatgttagaagttagcaagttactttagcattttgtaaataatttatcaaatgaaagatagctttaatttaaaagactatgatttcatttttcatttctttaggcatattaagcattaaatatcaatactgtattttattgcaataattagtaaggcataatttggtatcttgaagttgcacatgtttcaatcacttaaaattaattaacttaataacttcccataactccagctagaagatagatgagcatgtcaaataagttcagtgaattcccaaggtaaaataaatagtttatatcttctgctctaatattagaaggactaaataatgacctatatagtgacaggccaaaaacaactggtctacccctttcttcaaatgaatatttgtttgttttaagagaataacttgacaactacatcaattatacttgaggcctcatcacattgcaaaaatatttttataataattaaggcagagaatcaccatgaacttgaactctaattttgccatatccttagctgtttggtcataagcaacttacttgatttctgtgagcctcagggctttttttaagtgtaaaatagaaataataatacatactttgcaggattggttggaggattggaaatagtaagttaaagcacctggcacagatgtttaccttgtactagtagctatgcggcagctagtattgctcaaactatgtaggaatggccatcacatgtctcgtttcagttcactctgaacggtcttactgaagacttccttaatcttcactctgcatactcagcacaatcaagaaagcccgtgtgctccgtctttgtatacatggggttttgatttcccttcctgtataccctggtgagacagaagggctccttctggaatattctttagcctggctttgcttccgccttgcaaaaagttggggttaagtcagagatgggcgggtgctgggaaaactggccagttgaccaaacctttcgactaacagacccagtcacatatttggttcaactgaaggaaactgcattaggacatcatttcctgtacacctctattccattgttttagaaagcagtaggaaacatactggaggaaactagtgaaagtttacattttgtgtcctactttgtgttcatctcactccctttgtgggcaaggtaaaatattaatgtttcccatttacttaggttcttggttgtgtaattccaattatatggttgagttacagattccttactcccaagtgttgtttctttgaggtaagaaacaaaaccaggttttaagtttcgggtagcatccaacaaaagaaaaacatattgcctaaagagagcaaactggaagctttttagagtgactccctctggactgttaggaaaacaaacagcagagcaaacgttgctaatcctgtttctgctttgtgcttctggccatgtaggggatagagaagtgaatctcatgaggccaaaaatccatttccaatcctacaagtgatgcatttaatttgtcaggatgtaaatcagcaggacctctcagcatgtttgtgtagtataatcctaaccataaaatattcctcctcattttgccaaagcagtggtggaccttcctaagggccagctcactgacttggcggctgaagccccatcttactcaaacctggtaagtcccacacccagacacaacccctgacattccttggggaggaaacaaagcttaatttagataatcccccctgcaaagtgtattagctgatccaaaccagacctgaccaactaaaggcatgttgttgctgcatttcagagatgccttaatgtagaaatagcttcttgttgcatttggaggattaagattcatataaggaataaccagtggtaatcgataaactatttttttaaaacataaacagcttcatgcttgactttgaacctctctccacttaaataggaggagcacatttctttgttgcaatataaattgcctggcagagctcccctaattccattgcacatatgaaaataaacaataacaataaacagaatagggaaagtatgctatgtatcacaaatgggtattttttatttgtataaagaaaaacacttctcttttttttaagttgtttatggaagactatgtctaatttaagaacagatgttctgccaatactccatcacacacattaggcccttagacaagaagatagacagataactatagagatacagcaataccaggaggcatagaaattgatagaaaaataccccagaaccacatgtgagataatgccatacttgaggggtccactgtcgaaaaagaaagagatgtggaatggaagtgtaagatgcatgcaggtttttgtctgtgtgagcacagaaatgaatttccaattaaaacccaaatctctgaatttgtagtgaaatacctatattactagaaaaggaaattgctataatcctgaaaaaattaacattagcaataaatgatgtgatttacacgtgtaagaaaacctgagttttctgttgaaattagaatttaatgagaggggaaagttcatcagcagaaggcacaaatatgtttgggatcagaagtcagattcctttgagatactgaagtgcatggaagccccttctacctgacccagagtggagctcttttgagagcttgcaccctaactcacttttactgatagagcagagagaacaactttaaagcagtttgcctttaaaatataatatttcatagtgagaattctatagtaggaaatgataccagatgctgcataaaaatcatgatgggaagacaagaaaatctgaaatgatccagaattaaggtagaaaggatacatttttaagaaataaagagaaagaaagaaagaaagaaagaaaaagaaagaaagaaaagaaagaaagaaaggagggagggagggagggagggagggaaggaaggaaggaaggaaggaaggaaggaaggaaggaaggatggataaatatgagaaggagggaagaaaagagaaagagacagagtacctgagtacaagtggtgcataaggatggcatttgttttgcagttagggaggagacttttcaggcctcccagtttatgttatggtatcatgacagctcaagggtcagatacagacaaagatataatatgcagatcagtagggaaaaactaaagaatgtaaattcatgctggcaactctttcagaaataaatcaggtggtaacataactactgagagatggattcaaaccaccttaggttataccagtaaaatgaaatatgcagttattaagaatattagagaatattttattaatgtaaaatgacatctatctccaaagaagtcagacttccagactgtgtgtaaggtatgacagaactttttgtgaaaatgatatttatatataaaatgcagcaaaatatgcagctctttctgtatgataaagctgtggtttttaattttcctgtgtgtttttttttgtccttatgctataataaacgtgctattgtataattataaaaccaaacgacgactcagaaaaataagggaaaattgtcatcgttttacttatccatgattcctgggcaaagccttcacaaatagcatcttgaaatatgactgtaaatgtggttcacttttggtgacaaaattaaaccataaaggggtgaccctagattaaggggtggttgaagcatacctattacatacatgtataggtctggttactgtgaaattgcaggagaataaatggtatatttcaacaggattgttagttctagaacatttaatcatgcaataagggtcaagtcctgtcaagtttatttgtagttatacagctaaccccatgtcacagtacaaggataaataaatgtaacacttagaaatacaagtcatacagcatgagtgacccctttcagattctaaaccaacagccaggtttgtatttttcatgcagaagtttaattgtaattgttgcattatgctctacttttagcatgaagttgggaaattcttttagtttgtagataatatgaagaggccatgtgttatagtggaaagatcctgacacctaaattacattccaatttcggccactagcaagttgtgtgaccttggacaggtcactgccttccactgagtctctgttccctcacttgtaaagaacagaactagcagtcctcttaggtgccttcctggtgtggaatataaagggaactctagtgccaccaattcaatggcatttaaccagtttctatcaataccatggtcttcacctcaatattatgcataggaactgaaccttcttcaagttatctagataccccgaagaaaaatcaatgtaatgcaagaaacttgtcctaaggaagtcagtgttttgaattgttcatcatcaatgttaatgacttcaaaataatacactctttcattgtcccagcattcaagatgtctaagttccaattcaatcaactgaaatgattcataatttataaaacaagatggtgtgatgacatctataaagctaaccaaagaaatttactatgtccaaagtaaatggctgtaaatgacaactaaaaaaccaaacccttgatcagctttataggtaaattattttctagaaaaaatatacattttccttctctctagtgctatatttctgaattcaaaaacgctgtagctttgtaaaagcctaagaattggggtttgagtaggaatttaagaggctctattctctgttgttataggttttcattctgctgaaaaatgtcaatattttatgtcactttatttagtcatagaatcaaatttttgtagatatggtgagatttgaactactaccattagagaaattaatgctaaaagttatataaagcaaatatttcaagagtatcagcaacaatattaatttattcctgacatactagctgaatttaccttaagctctcctttatttttatattaatattaatttggctctatatttcatttttgtaaaccacctcaaccttatttgtttaagagttggcagagaggtgaaggatataaataagtacacacagaaacatttttggaataaagcaatcctcacctgtttttttcatggatcttcaagatttcatttgtctgttgaagaagttgcttctctagcttgtaggtggataatgaattctccagcagctgtatctcaagtcgagaagtttgatttagtaccttaagataaaagatgaaaatatttcaaacttcagtcacgaatcaaagaacttttttaagttttattttgtcgttaaatattttttcaagaataatttaacaaatggtttaccgccgggcgcagtggctcacgcctgtaatcccagcactttgggaggccaaggcgggtggatcacgaggtcaagagatcgagaccatcctggcaaacatggtgaaaccccgtctctactaaaaatacaaaaacttagccgggcgtggtagcgggcgcctgtagtcccagctactcgggaggctgacgcaggagaatggcgtgaacccgggaggcggagcttgcagtgagccgggatcgcgccactgcactccagcctgggcgacagagtaagactctgtctcaaaaaaaaaaaaaaaaaaaaaaaaggtttacattctacttatattctaccaactaatgttttacatgcctttcagatattattttggtttgagattgaaattgcaattgaacaaacatattgtgttttaggacttctgtgtcctaaaaccctaggatattctcctgtgctagttgcttcatatattttatctccaatatctgtaagtgcacgttagtattaagtacaaggtcttagatattgtgaataattaagaataactaataggcatgtaaaagatacctgccttggtggatcacctggcaaaaaacaattagaaatgtgcaaaattctcttgacatagtttagaaagactcattatcacacatttatagaacgcctatcacactaggtaatgctagcctttccggatatcatgaccacctatcaaaggagaaattgttatcatcactttacaaatgagaaaactgagcttcagacagaagcccaagttcacacaggaaccaagggaagagtggggtttcaaactcaggtagttttattctgattctgctgctttgcaaagaaaattaaggagacggtgagtcaaaccaatctgaggaaatgaaatgacccagaacccagattgtatgagagacagattgttctcatcctttcaacaccactattactactctggtggtcctctagaaactgtgaaggctcaattcatcttgaatcacaatgacccatgtgtccagctgggccttattatgacatgagtctgtgagctgtgcacctaaacctatcattctccaggcaaagaatgcacactccagtcctagcagatgccttcaaattgtgtcaatgccctgttcctgactctttcttgtccttccctctctttactccttaagggaggtataaaacaaagaaagaagataaattaattttaaaagctcctcacattatttgaaacattttttaactaccacatctttcctaaaactgcttatttaaaaggacctggaaatacttctgccaggtcaatatcaatgtaaagttcctctacaaatgatgccattagagccgtcctccttttctgcagcgtctctaaatctaggattacatcagatgcacacagaaagtctactcaacatataccaacagggccaggtgtggtggctcacacctgtaatcccaaccctttgggaggctgtagcaggtggcttgcttgagctcaggagttcaaggccagcctgggtaacacggcaaaaccccatctctacaaaaacatacaaaaattaactgggcatggtggtttgtgcctgtagtcccagctactcaggaggctaaggaaggagaatcacttgggcctggcaggcagagtttgcagtgagccataattatgccactgcactacagcctgggtgacagagtgagaccctatctcaaaaaataaaataaaataaaaaacaaaatacaccaatagaccctgggctggacttgggctacaggaatttgcaggagtaggggatgtatttgaagggagcaaggcaggaactaggctgaggtgagagaggcaaatgcctcagttgcaaaacttaaaggggtgccagaaatctcagtaatcaaggtaagtaatattttaatgtaacatttttaaaattttacaattaattcaagaaatccacatttaacagaatatcatttaaaaataaagacaggatctgattctgcacatgtatgatttggtctgatgtggtctcacttgcctcaccctacagtcctagccccgcaaggggtggaacaggagggtgaggaggggatggggcagagaatggtgagatggagcatttatactctaaaaaagtttaaactgctatgactcatttatacagtcattagtaaggatctgaaagcccgtctaaaatgtactactactaatcatattcatgtttgtaaagggtttcagcgttttaaaaaacattttttctattctgtattatttcatttcaaaacaaacaatttgaaggtagagtttggagtagctcagtggggataaatggtagagaatataaatattggagatgcacaagatataactttcaactattaaacatattattgtccaagtaagatttgtatttgtttattgagtgacaatttataaaataatgaaatagggaatgaaacacttgtatgttttggtgacatttagaacaaagcttggcacagagacaacactcaatatttgtttatggatactcagtatttgcttatgaggtacattgtctcactaaatcaagcatatcatatgcagttaaatgaaatctattttctttcttattcgccgtactctctgatcacagttcctgacattctcagacaccaaaaattttaatttccaaaagacagtaagtattctcctccatgtccattgagaacaaaatggaaccatttaaaattgaaaacaaagctgcccatatctcagtctggagaccactacagttcccagtttgtcttccttctcctacttgccctacctcaagtctatttgtcacacagcatccagagggatctttttgaacacataaatcagatcatgccatctcctttgcaacatgctaatggcttccctttgcaattagaatgaattccaaagccctcagcctggtctgaaaagacccacgtgatcagaaccctgttcacttcttgtttattatgctccaactacacagtcttctttctgccacattgactagccaaattcattccaatcttggaagatttgcacttgcagtttcctctgcttggcatgcccaccccttcctagatgcatggctgatttcttctcatcatcttagagagtccctttctggccaccttctttatagtaataccttcctcaccctccatcacatcaccttatttaattttctttacagaattatcactattgaaaactatcatatctattcactcatttgctgtctttctgcccctcctagaatgtcagctgcacagaggcaggaaggctcatctggagtcctctaagcctccagaccccctgggggcctaggacactgcagcgctcatagctgagttagatgacattctgggcaatggacagtgagctgtctttcaggcttgagtcatggtcacagaaagggtaacagggccgacatgaatatcaagttagaggtcagtgatgacagtctaaatctagagcagcatctgaatataggagaaggaaggagtccaatatcagaagtccaggctaaatgccgatctaaagatcagggcagtttagagcacaaatgccaatccctcctcttctttccccatcaccttgaccccattgctgctttatttcaactctctccactgatgtattaaactaggtctgaagcgggcaaccaagagaattgcatagcaaactatgataaattgaccactttcttgccatgcgactatggaattcgctgcttagcaatagttgaagtgttccattaaaatgacaaaagacatttccttcttagcctaaacacattccaaaagcacatctttggggaaaaaaaaagaaaatttttaaataagaagaaggaaaaggagtaaagcgtatgtgaaacatgcccctcaaggaacaatttcaaagaataaattttccaaaatatacctaagagtaagagagacataaaacctgaaattgaggatttacgggctacaaaattttagttcttttttttaaaaaagtaaacatttaaaaatgaaaattattagtttccaagagaaagtgagctggaaaatttcacccagctccctttaatattttcaagagtgcctctgatcctttaaattaatattaatgctaaaagtcagagattgaggtagaaagaaaatctcttttttttagagacagagtctcactctgtcacccaggctggaatgcagtggcatgaccacagtcactgcagcctcttgggctccggtgaggtgtgcccagcaattgtttgtattttttttttttttgtaaagacagggctctgccatgttgcccaggctggtctcaaactcctgggttcaagcaatctgcccacctcagcctcctaacgtgctgggataacaggtgtgagccagcgtgcctggccaaaaatctctttcaacgactcattaactttgaaataggccctgtttttagggttatgtttccttttgctttatttttttttccaaagaaaaatttgtaacataaaatatgatgccttggcaattaattctaacagaagaattaaggttgatacatgcagagggaatgagagagttagaaaatcagcattttgcaaaatgattgaagtaatttacttggttaataatggacaatgtgaccaagtattaccctacaggttatctgttaatttcctagggaaaaatgaactatcgagatgcagtgatatggaggttataaccctaaccaagttaaagaacagcataactaagggagtggcaatctggcatatgtgtctcctgaagagatccaataggaagtgaccagtaattccacagaacacctctgccacaatattccattcaacctaaaccagtctttagactcaacttccagtttacagaaaccataggggattgaagggtaaactaaaggtcataataaagaaatattcagacaaatgcagaacgtgaaatgattgacaaaacagcccagtttcttaagaatgtcaatatcagggaaaaaaagtagaagactgctccaaatttaaatggactattaaatcttgaaaaacaaaactcctataaaagttttagtggaaaaatgagaaaatatgaatgtagaaattagataatcttatggaattattgttcatcttagttgtgatgtaatatataattaatattatataactattacataatattctctatttatttatatataaatatattttatttataatggtaataccctcattatatatgtatatattataacataataatataaccctatattatatttataatataataaccacttcatttggttacagaatttaatagagataagacttatattacagacagagaactgtgggtagaaataactctcccaatacagctaatgctcagtagagtcagaatgcaacccagagagtctatctccggagtctgggttgtttcccacaggcttatcgagtagctgtaaataagcagcttccctctggttagtgacaccctctagtcactaacaactgctaccaaaatggcttctttcaagtcgccatgaggtgctctgcttgttgcagctgatggcatccaactctctctccctgcccctgccccctaaattagcatcacgagtaaggaaggagtccaaatttcttatgcttctcagagtacggaaaagaaaaacaaacaaacaaaaaaacccaaaaaaacattcactcagtgttcttagttgggtcagacatctttgcagtagactgcttctgttcaaagtcctcttctgacccatcagctatttgtgggtacctattacaatcaacacacaagcctcagcatattgccctcaggcttggtgacattgggctgaaacctgcagagattaagggactaaaacttagtcaatgtaattatttcacaagtatttattgagagcctatgcaccagtcctgttctaaatcctgtcgatagagcagtgaacaagaacaagacagaaacatccctgcttcttaggaatttatatcctagtgcaggagttggtcagatttttctgtaaaggcccagacagtaaacatcttaggcttggtgggccaaatggtctcttgtgtaacaatttagctccaccattttagtgaaatagcagccatagacaacatataaatgaatgagtgcagctgtgtccaataaaactttatctacaaaacaagatggctggtcaaatttgacctgtgggccataggctgctgagccctatcctagtggcttatcaaacaattttcctaaaccttgtaagaaaactaattacaggatattttccttagatgacccactaaagagtttgtttcatcatttcagttaaaagattcatgctcattgaacaaactgttcctgaactgcctaatacacacacacacacacacacacacacacacacacacacacacacacacaagtgtatatatatatatatttaaagatagggtcttgctctgtcaaccatgctggagtgcagtggtgtgatcacagctcattgtaaccttgaacttcctaggttcaagggatcctccagccttagctccgtgagtaactaggctacaggcacgcattaccatgcctggcttttttttttttttttgtagagataggatcttgctattttgcccaggctggtgtcaaactcctgggctcaagtcatttttccacctggctcttccctaaagtgctgagattttaggtgcgggccactctacctggcttgccttatatttctaatgagtgctattgaggtccaaacggcagatgtaatcatttgtgatgtctgaaaagatgattaaatgggattaaacatgcaggaaatatattaggggaaatgcccacgaggaaaaattgggaggaagccagaggaggtttggagaggcttcagaccgggatggtctaattacaggaaagaggagagggaaggaagaagagttgggtggaagtcttatccctcaaggcagccgtgcaacagttccagcaaggctgatgaagagcccctagccaaagtcatgtgtcagtggacttctacagctcccaggagcaggcctacatatccctgccacaatgagtggaagtgactgctggaaattgtggtctctggaccaacacagcaatggatttcagagcacagccattggtgagcactggtcaattatacttccgcaagtaggagattggaaaggtacatctttaaggccatgaggaagggctccacagatcattaatttgactgaaagttaagaaagaaatgacttagaagcattttgccacattaactcaaactcatgaaggtaaagactgctttatttgttgcattctaataggacctattaaaacatcttacatcaaggaagtacccaaaggcaggagtggttgctcatgtctgtaatccaagcactttgggaggccaaggcaggtgaattgcttcaacctaggaggtcgagaccagcctgggcaacatagcaagacctggtctctacaaaaaataaggaagttagctgagcatggtggcacacacctgtagtcccagctgctcatgaggctggagtgggaggatcacctgagaccagaaggttgaggctgcagtgagccctgatcagccactgcactccagcctgggtgacagagtgagaccctatctcaaaacataataataaaagataaggaaataaacataggatggtatatcatctaccttatagaattcattattattattaaatagccaatatatgtaaaattacttagaactgaggcaagcatggattattagaggcaaattttaaggcaatttgtttgtctgttagtttccccaaaaaccaaatttgcctgagaaagaagtgagaaatagaatgacactataggaagtgacatgaataattcctcctacaaaccccttcatattgtactcttggaaagaggaacttgaaggccaagagatattggtacaaactgataacagagtgagaaaaacactgcaagccagactaagggggaaggaaaaggcatggtggtggtttctgattcttgccaccatggccagcagagttattcagatgtggtcattactggtatctttcctgatcatgacacttttttgagcacaagaggatcttaaaatgccattggcatgaacctgtggctttctgcattttgttaagtcataaatctagaaggtcagcagaagattagaaagcaataagttaattatttcataacatcatcatgtgaaagctagtgcattaaaatatattggaaagacattgtcatgagttcctgaaataaactgaggacctgaagtcagttttaggaaaagcaacacttaccactgtgaagccaagttagatgaatataggaggaaaaccatgagagcatgcctggatagcacagaaggatctactggttttataaatgcttattataaatgaatagagtgtatggaggttaaggaataattcaggattacttttgtaaacttggctctgaatcaggatttgagttcacttgagtgattatgtctaagcagaacatgtcctgttgcaatagttcaaataagtagcacgagggtatacatttacatataacaggttcgaagcatcacagctacaaatagcataagcaattggaagacatgaaaatgaaagtgaaaaaaacacataggcgtcacttcttaaggtagggcataatttgagccattgtcatccttttctacttccctctcattgctacttgtgatggatttgtgatttttgaaatgttttctgggtttcagctatcttaaaattgttctcactgtatctaataaactttcattggtctttgatagtaagttttggctgcttcgtataaggagtagttattctttttcattgaattttctgtaccattttcaataaagtacacatcttctggccttaaggatgcagaacaatttatctctcaataccttacatagcacgcatcttaacagtttggagattaacgtgctaacaatgggacatttttttttcccacaactccaactgctaggtagacagagattaaaaaacaacccaagacacagtgttttaggggataaaaaaattaaacaagactctgccatgtgttccagaaaagttattgtaatagaaacttatacaaatttcaaatatgcaattaagtaggatatattgtgtatttgtttttgaacatgtgagagtattttgtaggagagggtgagcattctgttctaataaaataaaataaataatacagtcacattatttataccacaagaaaccaatgtgcatatattatcaaacttactgtgacaatgaatgattagataaagtcttgtaattttcagggacaatatgtagttccgtccatctcccatgttcatctgatgttgatgggcagcaaaaagtattttccaaagctaatgtgaatcactgccccaatgtaatcaatacttaagttcttattcaattagttaattattagtgttactaatcaagggagatagaaaagaaatgagtaccccagagtttgaatcccagattttataaactagctgcatgaatgtgagaaatcactcaagctagtgatttctagctaaaagatctatctatctgctctaagtgattttcataaaaaccatgtgtgcacgggaagttatgttatataggttttatctgtatcagtcatcattgctatttttctttaaataccaatctacctgtgatgccagtatcgcaaatgaaagaaaatagaaatcatgttgcaccttatttttgaacatatatatttcagctttcatgtcagaaatcaactacattgggatagaatcatcccttgggtttcagaatggtaactggaataatgattttcatggctaaaagggaaccaagagacaattaaaaatgacagtcatcaaaatgatagtcatcaaaaatgatatttgctatttgccagtaaactatgatggggtgtttgtgacaatggtgatcaaaggatatccctagtttttactcgttggtactcaaataagtacatcattggccctaataggtagatatatgtatatacacacatattcctcataacttcatttgagattgtcctttctatctgctgaatgcacaaaccgtctgcaggtgcccttatggctgcagcattaccagagacaaaacaaaacaggtcaaaaatgcacaacaaagacaccaatctgactcaaatggttactttgtttgacacatatcatatcacagttggtagctgcagtgcttatttgaatttaaacattgatgaggtcctttgctagctctgttttggcaaacatatgcaaagctaaatataccaaccctcattagatcaaaaaaaacacgcatagcatgtcaggcagtcattgttgttattaccaataaacaaaaatgtatgtttccctaatcacagtgctgaaatgtgctctgtgtttatggagaaagctaaagaaaaaaaaaatttttccttgttgagtctgtggactctggccctggggtgtacctgggtctcaacatctgtcagctttctggtctgctctgcagtctgagagaggaggctggttcctatctccagcatggtagccgtgtggttctgaactgcattctgctgtatctgggccatctccgacttcatgttttccacaatgtaattctcaagctgcaagagataaagaacaaaacatattacattataagcaaggcctcccagttcgggcatgtaatatttacaataacaaaacaagacaccgctggcaaatcagccatctggcggggatcctctacatctctgggagttggagaaatgggagcagagcacacaggaatccagttgtcaacaaattcctaatatactgatacatatatttataatcatcacaatcataatgacaatttgcacttggatcacactttcccattgttgacattatccatttagcctttatagcaaagatgtatcacagtcagctttattgttttgtttattttatagatgaaaaaatagaatcagagaggccagtgataaacccaaggttgaccagcaagaatgcagccaaattcacatactaatttaaatctaattcttggtgctctgatttttccgttacaccatactgaccacttatctcagaaaaattcagcctcctgcttccatttttgtaacgataaataaaatatcacactgctttggggaaatgggatgaggagtgggaggaaggatgatgtccaaaacaaaaacctttaaaggaatattaaaatataggcaatgatatatgaaatgagctgcaaagcctgagagctagctgtaatcattctccatgctcctttgcaagctcaaaaataggtactgaaagtacaacccatatagcagtatttactcctcttgctttgggtaatatttagtcctttatggtgccatcttagagaacagtatagtgctaaaataaatggtgccatagggaccatggagaatcattaagtgacttactgcaaggggtcctattaggtacctgggaaaataaagctgaacatatgcattgtttgaaaaatacaaggaaacctgcacctccctgtcagtgcatttaattcctccaccactgtgtggtgactacattttattactctactacacatatagggaaattgcatcccagagaaatcaggtccaaggccacacaccacaaaatcagccagacttggacttgagcactgaagtccttaactctcataccaacactttcaaccacttgatagctatgacaagtcgtgcttcacaagccgggttccaaatcattaacagctatgtgatttttactgatttagtgaaccataatacatccactatttcataatccatagtaaaattattatcatgtaataaatatagtctaaatgtaaattcccctttgtaaagctttggcagctcacttgctaacatcatcccttgcttatttctatttatcaagaacaaatctgtcccatgctaacaaaaatggttttcaatcaaactcttattattattaatacattctaaattcattcttggccaatataagataattccccttcattcatttttcccccaaattagacataggagggaaaaaaattcaacctataaaagtttattataaaacaaatacaaaatatattataataaatctctgaaaattatcaaaatgtaaggcctgtaggccaaatcttgactttattccaattgaactaacatatttaaacaacaagaggcaggtagagaaaaagagggtaggacagagtaataaaaatttgtcattttggattccacatcctatgttccctttttcctaatagcattctttaactttcttttgggaagttatcgttttgcccttcggaacaaatgcttcaggtagagttgtcccagcctagcatcacaaatgagtacaggttctaacttgtcaagccagaatgttctgctcctgcttcataggtgtgaattgttcaagaatggaaagacatcacaagcaaggccattagcctcagttctcaaattttatcaaactcatttataaaataactttgttttcctctgtggttaataagctggtgacatatgcccaatacagttgatgcccgattttgccaccacaaaaccagagtcagcccaaaaatgaagctgactcagacagatgttagataaggagattagatagatagatagatagatagatagatagatagatagatagatctatgtacatacatagacacttggatgcatagatagacacagagtcaggtgattccttttgagcacctggacctagctatatttttagctagttccacccttggacattcagttgtaagttgcatgatctaacagtctcccattgagcagccaaccttttttccccttcaatcacattgatttagatttttaacacttacaaccaagattttggattgttacttttgatcaatgtttagcagaagaaatttcagggaggaaaacgttaagagaatattccttacttttccagggaatttgaggttatacatgagtgtaagtttcttaaaaaattacagataagtctccattataaagataatagctatcatttatagctgacagttatcattgcctactatgcaacaggcacagagctacgtgttttccttttataatcacacttaaacttcacaattatatatgttatagctgctttatagatgagactattgaggctcagaaacccccaaacaacttgctcaagaacaaacaaggattcaacccacagctccaaaacccatgttgttaacctctaacctatttagcctagcactgatttgttatgctatgcattttattatatagctcttaaagcttgagtgttcatcaaaactacatggggagaattttaaaatgcagatggaggtaaaacacaccagaaatctttaagggcatgtactgggaaactgtatattttataaagcttcccagtgtaattcttattcaggtaaagaatcagtgcatctcaaagtgtggtccatagaacaactgcctgtatgagacctgcttgtgaacagtcagccatgaaatgaggagtttgcaccaggatgtaaattatctaggtcactaagcacactgtttagttcattcacttgatgtatatatatacaaacacacatgcaaaactttctcattgaagaaagtgatgctctagtttatattctggtgcaaacttcttaccatgtttcctaaatgacagcaatgtcattgagtaatactcatttaaaccatcaaatttactttgaaatatcagattccctgcttatcaagaaatctgtctttctatgcaaattttcctcctgagagagttcactaatcagtgagctccaatacaagatctgcttgataattgtacatcaatttcttatgcagttggttagcagtagtctgttcccagagtttgatttgctccaggtgtaataacaatcatgtaccctagtcttcacagggaggacaccctcagcataggtggctacatcaaggttcagtgtctttgtatcagctgttgaccattctgtactattgtgctttttttaattataaaagttaacaccagcaaagcaaaataactatttcatgctagcattcatcacaaccataaagtgcctctcagttctgctgaccctgttgtagatataaagtaagtctccaacctacactaaaatgctcatttaggctgctatgatgagtagcatgaatatagctctagttaattattttttaatcaaatggggctgctttctccaggagtaactgccttttaatgcaaaatctaatgccacacttaagtagcaagaaccagatgtagttgatttaaaggctggagcaggaggcagaagtcaaatatacaatgtgtgattaataaggaggactgctttcatcttatctctaaacattcctctgtagatgtataactgtgaaatccatcttgatgtgccatagcagccaggttcagaaaagatttgtaacaaatttgattgtcttcatatattccctactggttttaaaatatgtttacagaaaatgacagccacctcaaggttcaatattttataaacatctaagatgtgaattttaagcctagaagttgctgaccacaagagctaatgagttataatgtaggagtctctcaacctgaataataaaattatttgactatactgccatgccagagttttataagttattgaccaaaatgctaggaagagaatgtgatttgaaatgaaatgacaaacaataaatgattactttcaagcaaaaaaaagttgcatttgttaagtgatttaatatttgcatagcttttgtacacattgtctgacttcatccttataccaaacttgcaaggagagaactgattccattttatagttagaaatccgaggccttcagtgacttcatagaaatcaaagaaaagccagacatcaaagaaaaatctcaactctatcttctgatgttctactagcctcagagttgcgggaagtgttctgttattggactggttggctggatgattagttgactgataatttcaattttagtcagctattgcatattcattattataatatattataacatacacaatatattataatatttataatatttattcctttgagaaaaacatgcatcactagagggggattactttcacttggtttcactatagtggagaccaagttaatttgaggtgggatgagaagccctagggccaggtatgtggaaagtttatttgccagtacttttaatagaatggaatcattaaagtcctctcattagttcttacctttttttcttagtaacataagtttattttgtctgctcattctattttcttgccaaccattgtaaaatacaacaaagggaataacaataatacacaaagcctctacaaaggctagatatgtaccagcttttacaaatacgcagttcattgaatctttagaacaatccaggtactgtaagtattattttccttatttcactgatgtctaaacagaggctcagggaagttaagtaaactgtctaagatcatacagtgggtttttggcagagctggtatgttgctttgaggctagattgaccagtagcttgtgctccattctgaaggaatgtcactcatcaaacacaagcatattgttaccaatgttaaaaacaaattctgataacatacaatattcatgcacaaaatatgtaaaaatgaaagctacagaaatgatgaggtgaaacttgttcaaagattgaccattttttaatttatacatttgcatattgattgatggctgtaatatcttaggaaatgttacccatggtgagaaggcaaatatccagtcaactgtatgaaaagtcttagtattaagtaggcaaagaaaacatatttttaagaaggtaatataatcagccatttgtagttctatcataaatcacatgcccctgtcttttgcccaatgaccaggggagaactgatgctatcattctccatcatgagagagaattttgggagagcttttactagactctcaaaacccttgcgggcttcagtttcatgagaaccaaaatctgtgtgagattatgacatgtcttgtatgtgaaatgcattctgtatcatttcacttgaagaaaccacttcaaggggtctcttaaaccagagcatatcttaaagcacaaataatacaatttctccatgtaattcttaagaaagtaacattttaaaccctataaaaattgacaaaggcattgttcacttaaaatatggtgcagattaaatggaccttcattggatgttggtgcatatggcattactcagttatgacaaaacaaccatgaaataaagcaaaagggtaaatatgggaaagcaataaaaaggtaaaacaatgcaaaaaatgccttaaatgttgatggttttatctaatctcattgttccataaatcaatggcaatatttaaaatgcaactatatctaggtttatggccttattaaaaaaaaagacagctgaagccaaatatattattttcagggatttctattattagatctcccaatatactatttcttttatgaaatggagaaatataattgtctttttagacaatagatctatttagctaacatttaaaatggtttctgtgtggatatacatgccatggatcccatttctcattttgatatctgaaagaatatttactatttatggaagaaagaaaaccattagtacaagagagctgaaagagacattaaatattatgagctccaaggatcttgttttatagatgtggtgactgaggttcagagaggttatagaaagcaaggtgaaacagctaatcaatgtcagatgtcaggtcatggcccctctgtgtgtgggaaacccaggctcacatcactaggctgagccaacaacaatggctgtcggtaccttagacccaccccacatttctttcccaattccctggttcctgctacttgctttgcctttgctgattcctgatttggatctcccctttcgccaactcatgctccatccatttcaggggtcttgactttctttgctggactctgttcttgcttcctaccattgatacccatcagctgccccctggtcattgagcctcagcaaccccttgattttttttcttcagatgcatcacctcacacatggcaaaaaacagaaccaaattctaaaattagttcaggcttatcaccccctgtgtcagttcagtttagtcttagcatatatgtggtaagtgtgtgctgtgtactaagcctggtgccaaatgctacaggtacaaagagttgagtctagcaggaaatagaaacacgtgaatgagtcatttcaatagaattggtgaatggggtctgcctctgactatgtttctttctgtaaatattctttctgcttgatagggagatgctctcagatactgatactaataatgtgagtggatgtttgttactcagcctccaaaggaatagtagcaacatcccactgaggcatatatagaagctatcaagggcaacccagaaaatcccataggaacaaattctcctgccattgctttttttggtaatgattcttgtgggaccacattcttgtggctgctgaaagttgccaaagtcatttacattgcccctagagttgggccaggacccaggaaagtcattctctctttgcataagcgaatgtctcctgtgccaaaacacattttactaacctggcacctctcttctacacctaccttctcacactagtaaaatgtcagagtcatggaacctcaagcatatttgcacgtctgcttaattttttcctttacctttttttaaaaggcacatggcatatagaaagcacattcagccaggagtcaggatatctggattttaatccaggtactatcattgatatactccatgaatttggagaaatcacttaaacactttgggtttaagttcttcatctatgaaataaagggctggattcgatcatttctaatgactcatgaagctctcaaactccttgatttaaaacttcctttataaagtacaagagtctataaggtttgaatattaatttattatagaaaattgaaatctgaatgtatatatctataaaatataacatacatatccttaatggcagtaaagaaacaatgatactagaaacaatagcaaagccctggactggatcatgtctccatagcaggcacatctgttttaagataaagagctagaatctctgaatcgcttaatccccaggcaccattctgtcccaaatatattccttgtctttctccaacacgacttggctttctgtctttaatttttatcacagtgaacggcaccattaccacctatctgttcatccaagccacagagaatcaccttgattagtcttttccttctttttctacattaaatccacaccagatggtgttgcttttttttttttttttgagagggagtctctgtcacccaggctggagtgcagtggggcaatctcagctcgctgcaaccttcgcctctcgggttcaagtggtttcctgcctcggcctcccaagtatccaggcacatgccaccacgcctagctaatttttgtttttttagtagagacagggttttgccatgttggccaggctggtctcgaagtcctgacctcaggtgatctacccacctgagcctctcaaagtgctgggattataggcgtgagccactgtgcctcgccctctgctgtctcttgaaggctgcctaggtccatccctctcccgcttccctctctccctaccaatatcactttattctcacagtcactgactaaggtcagactctcatcagttttcttctggatttgttaatggccccataactggtctcctgactccagacttgcctcctccaatccatcatccatgccatagccagtgggatcaatctaaagcacagatttggctttgtcatgtcactgttcaaactctttcagtagcttctactacctgcagataatgtcacaacactgtattcgtcatagatgattcttaacaatctggaccccgaccctcccaccctacatgtactttatgctccagacataccaaatgaccacagtattttcatttcactaagcaaacactctttttgactcatgtctttgcatatgactttgctccaactggaatgcttcttttcacatttattctcccttttcttgggctaggtcctatttttcaaaactcagttcaagcttttcctcctctaggaagcctctcatcaatcttctctctgtaatacccttcttttctatttctagagcacctgtacctctgtttttcataatagccttattcaccacccttcctttctacttctggagcacactgtgcctctgtttttcataatagctttgctcaccatcccagtataagttccttaagcacaagcactacctggttcaacttggtaccacttcctttcactgcctggcacatagtggggtctcaataccattttgataaataatttaatgcataaatgaatttgtgtatgaaaatactgagtctcccattgtgagcttagcttagttccatttgtttctctaagtaagaaatatcatattagcaattatcaatgatccccttttgaatggcaaaggaaccagcattaatgatgtacatagctctgaaaacaaatatcctcactttgtggaccacataaacccatcttgtcttactatgtctttctactttgctattcccaaacatctcgactatgagtcattgtttaaatcaagtaaaatccatgaaacacattgaaaactaaccatgtcttaatcattgcttcatacataaaagcaaaagaagtaaaacttaatgctgttcattgagactgcttataacataagcatgctacaaatgctggactgaaggtatcaatgtcctgcttgccttcctgcctgcctgatgggtagaataaagaaaggaacaaatcctctcaacgagagaatctaataagtctttccagaggcagtcccaaaggaatatagaagggagggcatacatttcttttgtctcctttaatataaaaaaaaatagccttatggcaatgacactgcattccagcctaggcaacagagttagagcttatatctgaaaaaatacagcctggaaaaattgagggctaggggataagaaaggactctgggaagactttgagagcatgcaaggagctgtgcttgcttaggcaagatgactctcctgcttacctcctgaaatgtgcttcttgggaaatcaagaaataaatcagtcagaagcaacagcataccattaatgccataccacacacatgcggcaagggcacagcatcagagttttaatatgggattcaggtagaaggcaaagacagataatttctgtgcactttaccatattttcagacatagtaagcataagatttacccatttaataacatatataagaacatatgttgtatgtacgtatatacaaacatacacacaaatacatttgcacaattatgctcttgtacacacatatatttccctattcccaacctacatgtgtccagttctacattcatgctttgtagttatgttcatttcattgcagtttattttcttaaagatccatttaaaatagccaacgcatcactcacctttgaatgaggtgtatttgatgtaaaatttaatcacttcagaaaatgcccattaatctgtcatggacagctccagtattctgcctaacaacacagaaatctttttcccaaattctaaaattatacttagatgacagaagaatggaagaattaaaaagcaacttggtatgcattgtttttataacaataaaagggatctttttttaactaaacaagatactgtttcaaacaaaattgcaaacatgtctccctttactgtaatgctttttagtttcttgcttatctgaaatgcaatttaaccccctgcatgctacacaaaatacattctgtttcacttaaaaagagaaagatttgacatttgaactacagaccaccccagcagctagtagattggggggattgatggggtaaaaggctctccaccagataattcttctaagaaacattttctgcaaaccacacttacttctcctctgacaaatggcagcgatgcaaacacatagcttataatgatgatcttttaaaagaaatcttctgcattcaatgaaacattacaggacagatcatgaaatttaaatacccagcagatgatataagatactcaagaacagaagtttgaaagccttaacaattaagggatttgtcgatttttcaggaataccatgactaggtagaaaattgtcatcattttactctggtattttgtatgaaattggaaggtattaacacttaaaatcaaatctctttcaataaaatccttcactgttcaacactctgactttttaggctgttattaccttttcatttatgctacatcttttcttgcttacaatgaagttgctttgttggttgtctttctcttctgaaatatcttgtttatgggtttttaaaattaattttctttcatctgcttaaataaagtaaaataaatgataaaagtgtgtgcatatatatgtgtatgcgtgtgttttctcccacaatatgagattactcaatggaacatatagtaagtttgtacaggcataaaactgtcaatgtcattgtataataaacattccaaagcattatgtgtgaggtccaactaatttttttctgaataatatttgttgagtagttcttatttaaattacccttggtccaagtactggaagaattattaggacagaaaaagtcattcaaagcataagaaaggaataatgattgctgacatcttataaatgcaataaaatccctatttttttttttctccctttgatcaaaggactagagacagtgggcattgtttcatctttcacaaaggccattttggtgccctggtgatgcttgttacatcccaagtgctattggatgagagaccaaattagcattacaatgaactggcttctctgagaattaaccatacaccacaagagaatgaaacgaagcatgagtaactgcaaaaatacctgctcttgtgactacacatattgccagaggaattttgtaaaagtcagttttaaagactcattaatctagttttggcagctgtagatcacctcccggtgttcctcctgatttagtccccatccccaacaagctgggagaactggatactttatatattcattaactgaaagaagcctgggctaatttattggaaagtctaaatcctgggttcttatgatcatgaaatgtggataatagagaccagaaagctgccatacctacttaacagacatcacactttgacatatttattttggatgttttcatttttagtaagaaataaattactacatataaaatcaaggtcccacaatcagaatataacctttattctgaagttgatgtgggctttttctccataggtttatattcaaaataatatactgtctggtacactttcatgatgtacaaaaatgttaccttattgcatgatttcttcattctcttatttttaaatcaatattatgtttttgagacttagatatattaacagtattgttttactgtaattacaggactgagttagacttagtaattctaactgctaataaaacattctcatatcccaacgcctgacttactccgaagagaggagtacaatgtctttcagattcctgttaccctgagttctagctcagacacaagaaggaacaaattgtttctcagactctcacaaagcccccagggtctcttctctaaggatgtgaaggaaagctgtgtaatgaatcttcccctatttaaatactatatctcaagaatctgaatgaataatttttatatttggcaaatagttatttcccagagagagcaattagggggttgagaaagaaaggaaacatgttaccagaactaaaaattgattctatagttattctcaaacataaattactacattgagtttaaaataaccattaccacaattataaagacagctcccccaacttcctagcagcattccattgaatagacaagatagtcttgattttaaagtgcaaagtggcttcagtatactagctttccatggcttacaaacaaacaaaaaccatttctgttcagcataatacacagtacacaaaatgatatatttagcatgttctcaattatggtaagtatattcagacacaaatttgtatgcatttgaaaaagaaaagaaacactgaactgttaatagtgacgatctctggctgacgggaatacaggtgaattttattttcttcttgaaatggtttggttggttttctcctttctttagaaaatgagaattcaattttatacccagaaataaaataaagaactagagaaagaaagaaatgtgcttggaatgcattcattcttagtaggaaacttacaaacatctggcaaagtttagtggtggcctggttggagaaattctggaaaactctgctgccctccatagacattccccactggctcagccagttttcctcgtctagtcttactccctacctgccacccctaattctctggtttcataagaagtcaagaaaacaaacaaataagaagaaataaacaaaagagccaaaacagccgcaagtaggtctttaccaaggggaaagtgctgtgtgcaaagcctgtaacaatcgtctttgttttttgaatacttcttgtggatcagccaatgaggtaaggtcttgaggttcttcctttaattatttctcacagcagccctttgaaataggtatggttaccatctcagaccaatgaggtggcagaagtgatgagaagttcagtaacatgatcaggactacagagcccaaatattgcagtcgatattcagactcaagtctctttgatgcccgggtcactctctttccgctttattcagccccatgttcttggttagggcaagaattacaaacaggccctttgctgcccaagttcaaacagccaaagtgttttgtttgactagcacattatttttaaaatatggtttcaagcctttaacaagagtatgtaatctctagttatccacagcccatacctctcttggatataaaacttctggcccttttagctattaaggtcagttgcccagatcctaatggcatttgagttgccatcattaagcgggaaatgaaggcacctaacatttgatgatcaccgtcaggcagtaaaaaagtcttcatatacttgttgtccttttaaaaatacaatgaaaagtccccctcaccactctcacgcttagaaatactgaaagaatgattgaatcaacatgtggcaagacatttgaggactttgtaagcccagcataaataagaaacataataattttatatgacaagttgacttattctttcctcaggtccatagtgacatgctatttatggccacattaattatctttgctgaaaagcattagcattttctttcatttactcaaccaaaacagagacatcatcttcacgtgcatatggattagtatcatgtttgttctcctgttcattacaccataattccttcaaataagcacaaatatcaagcaaatatggattctaacattattatatgcacataatattagagcatattctcatagaatgagctctaatattatgattttttttaaagtttactaacaaaatccaatcaatattcaaacaagccatttttctttgggaaatagtgttttcttctttactaaactaaaacatgttgtactgtaaattgaacctcctgagctggaataattttatctcaaaaatgttttggttgttgaaagcaaagttatgcttaaagaaaatttgcagatatatatatatttgtatagaatcttaaattggaatatatatagaatatatatagatctatctataaatatagaatatatacatacatatgtatctgtgtatctatatctatatctatagaatatatgtatatattatatatcaatatagaatatatgtatatattatatatcaatatagaatatatgtatatattatatatcaatatagaatatatgtatatattatatatcaatatagaatatatgtatatattatatatcaatatagaatatatatatgggatggggtaatagacagttcatgtttccccttgaaaatgccatatcttattaagtatgtataagaacacggaatggtagtttaaatgtcagcaaagacaggctggcgcagtggctcatacctgtaatcccagcattttggaaggccaagacaggcagatcacctgaggtcaggagttcaagaccagcctggccaacatggtgaaaccctgtctctactaaaaatacaaaacttagccaggtgtggtggcagacgcctgtaatcacagctactcagaaggctgaggcaggagaatcacttgaactctggaggcagatcaatgagctgagatcgcgccactgcactctggcctggatgtcaagagcgagattccgtctcaaaataaataaataaatattagcaaagacacacagatacatacacatatgtagatgtgcatatgtattatacattttcacatactttcttatataaacacatttcaatgagcatttactcagtaagttttatatgtgtcctatgctaacaggcaacgtgccatgaatacataaatatgaaaaagatgcagttcttgcttagtccctggcaagtgagaaaaacaagtatataaacagatatcattataattagtagctgttaaagtggaaatattctctacaagattgtaaaaaatatactcaaagtttataaaatacatgacacttttattccatattctcatagagaagaaatacagtttcaaggacttcttagtaaattcagaattacttagtacaaacatgtcttggagaaatacatacttcatcagcctttttttctgtcctgatgtgcattcccacccagggctggctgttctcataattcatagctttaatattaaaattgtatcatcatcattatctccaggaaaccatgaagcccaaacctgatagattctaggatctcattgaggccttttgcattcttgacttcttaaagccaagggttctcatgtcacagagatgtgtttaatatgagatgtgttatattaaaaagtctaatgagtttactggaaaaccaccattatagaaaagaaattatacatttgctttttcataattctcaccattttttttctgtaaaaaaggaagagtcagagattataagtaatttcccagaagacatacagttacatgaggcttacccagcttgtctaggattgggctaatccacaccatgcctatcttcccagttgtaagaatttctcatatcaaaaatagagaatctttgcaatctacatgacttcttccaaactgggggaaatgtcttggtgaattcccacaggcaggtagaatgttgcggcatgaagagctatttttaacatggtgctatggagagctcccagaatgtgtcagcagggaacctgagtgctttttttttttttttttctcccacttgtcagccatatgaactccaaggtcttttacttctgtgagataaatatttctcatcagtaaagccatcaggctaattgtacctgtcctaaacatctcaaaagtttcttgtaatgatcaaatgaaataatacatgtcaaaatgcttggtcagatgtaaggtgccatgtaaatgtcagatacttatacttcgatgtgggtaggttggaagaagcagtttgagaatctattagaagtgtgaattctctggtgtaactgcatatacagttatcaataagaagacaatgaacagctaatactagccaccatattattgctttttccaagttctgatttatatttacgtgagaagcagcacatgagaagcagtgtttgagaaagaataataagttttggactctgttagctctaagctggcaactggctagctgtgtgactttgagcaagttgctttccctctctgtgctttagcttctgcatctagaaaaagcgaagaataatgcatctgtatcatagtattgtttgaggattaaataagaaaaatcataaatatacctaaattgaaaaataaaataacaagcttcaaatgggaagaatgggattaaactgcctcagtgggcatggatgtgacagatggcattggacagtaaaaaaaataataataatagaaatttgttacagaggcctagcttcctaatacttattaacactgtgactatgaacaagccacttaactactctaagcctcaacttcctcatctgtaaatataataatatctacatcaaagcagttttgtcaagaatgaaactatttcattaactgtagctataaaaatatagtcccctgactgacacttgctgactgactaatactacagttacgcaaatctaagtatctttccttttaacactatttcagtacatctatatactacaggctggccataaagtctataggtaataatatcctattgcattttaatgtaatgtcagaaagccatttactatatatatttactaatttttccagccttaaggccaccagtggacttactcttttggaattttttatatagcaagcaagcatccacaaggatgtttttagttatatgattaaataaagaaatgctaaatccctgaggtttatgaaataatacaatggttaatattattattactacgattttttgagacagcgcctcactctgtcacccaggctgaagtgcagtggtgaaatctcgactgactgtaacctccatctcccaggttcaagcaagtctcctgcctcagcctccctagtagctgggattacaggtgtgcgccacgatgcccagctaatttttatattttcagtagaaccagggttttgccatgttggtcaggctggtctcaaactccagacctcaagccagccacctgccttggcctcccaaagtgctgagattacaggcgtgagccactgtgcccagcccgatggttaatattagctgttgattgtcttctcattgataactgtaaatgcactcacaccagagaatccattcttctaatggattttcaaactgcttctcccaatctaactacaccaaagtgtaagtatctgacatttgcatataaagaaacatcttgtataacacgtgctagttgtttcaaaacttcaaagggaattttctccttgagcaattttaatccagaaaaacctgtaattatgatttcaatgatgaatagaccacaaagtgctaggccagcaattaataaagtgagagactgcagtgaacgcagttcctagatgtctttcagaaaagaactgtgcaggtaagaggtgtagggagcaaggattggaggaagattgcagaagggggaaaaaaaaagacattctaaacattatagttaacacaactacctgaacatctgacttcaaggaatgaagcatagaattattcatattataaaaatattcatcaccttatgtagtacacaagggcccagaaagtaacaatattgcaagcatttaaggtttttattaaaacttcctgataaattgataaatagactgataagctgaagcatttcaagttactgatgatactatcaatgcaatggtaagacaaggcaaatatgacattagaataaatacaaagcacatttattcatatggttcactaccggaaactcagcatacttgacaatgggcagcctcaaatggtgctctcccccatgagaagtagtgccttattaagacagattgatgtttagaatttcataaacctcaggggcttagcacttctttatttaatcttataactaaaaacgtccttgtggatgcttgcttgctatataaaataattcccaatgagtaagtccactgagatttctgagtttcctgtgactctcaccattaatgcatctgcaaccaccatggtattgggcatgaagcaataagctgtatcctcatctggggcatgtctactggtctaacatggaaaggtcatgattccatgagcattgggatttcgtctttcaatgggattgtaaacaggaagaggctctccaacaaagagacattaaaatactctgccttccaaaacattcagatagatgcaatcactagaagagaataagattggttcttctcaggaaaaaaacataaacataactaagtcaggttaaagtagtggttttctcattttcttgactgtgacccacagtaagaagtgcagttttaattaggacaagaaacaaatacaacacacacacacacacacacacacacacacacacgattttgcctgtatacacaaatagaaataaaagtttcattaaaaaatactaaatccaattacacagtaaacactagaacccaggtctctgaccctctgatatttttacaatgtttaattttatttcatttgtacaaaaaggcttgactcaatccatttttaattttctcaacttactgtggtcataatgttcagttacaaaacactgaattggaaattgatgctcaaaatattatttattatgttatcactatatgcccagtaatgtgctaaatagtttgctcacatcatagcatttagtcctcaaaccaaccatcagagatgagttttactaaatctacttcatggacaaagcatctgagattagaatttagctctgcttgtgcagacaggaaatgggagagcagagattagaagtcagtcttttctaattcctactcattcaaatactttctaattcttatcatattacaccaccaaaaagccaaaagttgctacttcagggcagactaaacagaattctggttaaattagcacaaaagtatctctgtacaattaaaaaaatataactggcaaaacctgaaatacgtttgctgtgtttttttaagatcattgtatatatgtacaataaactcaacacagttgtccttagaacatgggctcactgttttttatccagaaagcttgttgtcattatttttaagttaacagttgtgaaacttaactgcgtattgttacttataaacacttcaattggatgaactcaaactgattattgaatctaaagacaacatcaatatggtgatcagcttctaagatggtccagcgatccctacctcatggtagttataccctggcatagtcccctcctgcattatatcagagttgatctgtgtgatcaatagaatatggcagaatagatgctatgccacttcaaatattgcattgtaaatggcactacaggttctatttgcattctgtctctctggctctgtctctcgggctctgtctctctgatcactcattctggggaaagtcatactgtaagaaaccttatggtggagagacccacatggtgagaaactgaggccttccaacaacaacgggggaatagaccctgcagccccagtcaggtcttcagagattgcagtccctgaaccagaatcacccaggctaagccatccccagatcccgaaatctcacaaactatatgagatgataaatatttgctattttaagctacatgaatactttggagacattatgggtttggttccagaccaccacaataaagcaaatagtgcaataaagcaactcatacaatctttttggtttctcagtgcataaaaaagttgggtttacactatactgtggtctattaagtgtgaaatagcattatgcctaaaaaacaaggtacatatttaatttaaaaatgctttatggttaaaaaatggtgaagatcaactgagacttcagtgaatcctaatctttttgctggtggagggttttgtcttgatgttgatgactgctgactgatcagggtggggtgatgattgctaaaggttggagtggctgtgacaatttttaaaaataaaacagtgaagttatccatatcaattgactgttcctttcactaaagatttatctaaagcatgctctctgtctctctctgtctctctttgatcactcactctggggaaagttatactgtttggtagtattgtaaccacagtagaactttttcaaaatgggactcaatcctctgaaaccctgtcaatactttgttaaagaagtttatgtaatattctaaatcctctgttgtcatttcaacaatgttcatggttgttgaccaagagtagattccatgtaaagaaaccactttccataagaagcaactcctcatctatttaaggtttatcaggagattgcagcagttcagtcacaacttcaagctccacttctaattctaattctcttgctatttccaccacatctgcagttgcttcctcaactgaagtcttgaaccccttaaaatcatccatgagggttggcatcaacttcttccaaacttgtgttaatttggatattttgaccttctcccatgaatcactaatgttcttactggcttctagaatagtgaatcctttccagaaggttttcaatttactttgcccagatccatctgaggaatcattgtctatggcagctttagccttctaaaatgtatttctttaataagaccagtaagtcaaaattactccttcatccatgggttacaggatggatattgtgttagcaggtataaaaacaatattaatattcttgtgcatctccatcagagctcctgggtcaccaggtgcattgtcaatgaacagtaatactttaaaaataatctttttgtttgagcagtaagtctcaaaagtgggcttaaaatattcatcatgccatgctgtaaacagatgtgctgtcattcacgctgtttggttccatttctagagcacaggcagagtagatgtagaataattcttaaggaccctaggatttttgagttagtaaatgagtattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttcttaagaataattcttaaggaccctaggatttttgagttagtaaataagtattgtcttcaacttaaagttaccagctgcgttatcccccttacaagagagtcaacctgtcttttgaagctttgaagccaggcattgacttttgctgtctagttacacaagtcctagaaagcatcttcctcaatataaagttgtttcacctacattaaaaatctgttgcttagtatagccactatcatcagtgattttatctagatcttctggataacttgatgcagtttctacatcggcacttgctgcctcaccttgcccttttatgttatgaaaatggcttctttccttaaacctcatgagccacaacctctgctagatgcaaacttttcttctgcagctctctcacctctctcagccttcatagaattgaagagagttacgccttgctctggactaggttttggcttaaggtaatgtcgtggctggtttgatagtctatccaaactactaaaactttcttcatattagtaataagcctattttgttttcttaacatttgtgtattcactggaatagtattttaatttccttcaagaacttttcttttgcattcagaacttggctaactgcttgttgcaagaagcctagctctcagcctgtcttggtttctgacatgccttcttcactatgcttaattatttctagattttgctttaatgctagagatgtacaattcttccttttacttgaacactcagaggccactgtagggttattcattgacctaatttcaatatttttgtgtctttgagaatagggaggcccattgagagggagagagatgaggaaatggcccatgagtggagaagtcagaacacacataccacttatcgatgaagttctcctactcatttgagtgtggttcatggcactccaaaacggttacaatagcaatctcaatgatctcaaagatcactgatgtgccaagtgcagcagcctcccagctacttgggagaccaaggtgggaggtttgcttgagcccaggagttgaagatcagcctgggcaatatagagagactctgtctccacaaaaacataaaatttgctgggtgtggtggcacgcatctgcagtcccagccactcaggaggctgaggtgggaagattgattgagccatgggaaagtcaaggctcagagagccatgatcatgctattgtgttccagcctgggcaacagagcaagaccctgtcaaaaagagagagagagaaagagaaagaaagaaagagagaaagaagaaagaaagaaagaaaaaaagaaagaaagaaagaaagaaaggagaaaggaaggaagaaggaagaaagagagagagagaaaaagaaagagaaggaaagaagaaagaaagaaaaggaaagaagaaagaaagaaggaaggaaggaaagagaaaggaaagaaagaaaaagaaagaaagaaagaaagaaagaaagaaagaaagaaagaaagaaagaaagaaagaaagaaagaaagagtcagggtcagtggctcaggcctataatcctaacaccttgggaggccaaggtgtgcagatcatgaggtcaggagttcaagaccatcctgaccaacatggtgaaaccagcctgcccaacatggtctctactaaaaataaaaaaattagccgggcatggtgggcgtgtgcctgtgatcccagctactcaggaggctgaggcaagggaatcacttgaacccaggaggtagaggttgcagtgagctgagatcacgccactgcactccagcctgggtgacagagcaagactctgtcaaaaaaaaaaaaaaaaaaaaaagaggaagaagaaaggaaggaagaaaagaaggaaggaaggagggaaggaaggacaatgaaaagaaaaaaaagaggaaaataatcactaatcacaaataaccataacagataaaatgataatgggaaagttctaaatataatgagaattaccaaaatgtgacacagagacacaaagtgagcatatggcattgaaaaaatggtgtcaatagacttgctcgacacagggttgccacaaacctttgatttgtttaaaaaaaaaaaaagcaatatctgtaaaatgctataaagtgaagtgaaataaaacaaggtaggcctgtactaaattttggtataatttgttaggcaaccaacagataatcgatgcaaacagttacagcttgaacctggcgagatgccatctcaatagggtttttatgtatgtgttacatggtaactttaaggctggaaaaggaaaaggaaaaagagaaataaactaaataatcagtgtagtaggatcaaagtgtttacttttaggctttcaaatcaaactacacagtgtggactagagtctactgatgcaatttctaaatcattgagactactaatcccaagcagccaataaaataatttgtcagtcaatctgtgaatttgtcagcatctcttttcactcttgttctccccagtcctcagctattttgaaaatcacatctcattggaagttgaaccagaaaaaagaagaacactgaagcttacatatgtgttctgctactctttgtggtttgtggtggaggctagttagactaaatttgaaagttggcaaaattgggcaccataatccttcttcaatcccctctctcttggtgctgagcattcttttttttttttttttttttttggacagagtctagtcctgttgcccaggctggagtacagtggcacaatcttggctcactgcaacctccacctcccaggttcaagtgattctccagcctcaacctccctagtagctgggtttacaggcacccaccagcaggcctgtggtgccgggcattcttatgctgtcttccacctgcctaaacccctcttctatggcatttacccaggactgcctttccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatgacctctttgacaaagtgtaaatccttctccatttcctaacttttcagtatctcaattacctactctcttaagtggtcattaacttcaacactatttttagtcaagtacaaaatagatttttttttttttgaattagagagtgtatttggaggagatctgaagaaaacatacaaattttgaaggaacactgtctttttaccaatgggtttctaagtcacagcatcttatttaagattcagaggttgaattttaaaatatgctgaaacatgaaaatgatacaattgaccactctggaaactggatagcaaatgcagtgctgttgggtttgagtatatctgtcatgttggaagaaggaatgagaggtggattgaaggagtgaaatgatgtagtccatgagggatcattcacagagacatttcctctccaaaaagatactatttaccacttgagcctgaagaaagaagtgagataagttctacgatgatggaagtttttctttctaggggctctcttgaatatattctttaatgccttagcaagtctgatgaactgaaagatttaccatatttttctaagtgcctcactttcccttcaggtacaacctgggctttcaggaaaaatctgacttattgtgtcttataatgaagtagaaagacttattaaaaacagagaattaagtagatgaacataatgatctttttaaatgacctctcattattctcttagaagaaatgacttagttaagaagaagagtcttggaaagatactgcctatgctagcactcaactcgtgaaatgcttctttctccagtgaaagtcagctgtttggttccctttccaaagaatttctgaacttagcaccacttcaatttgctgctctaagaatattgaccttaattcccatttaagagagtgaagggttaggattaatgtttcttttttatatatgctgccttgcaaaaccctttccatttactcataaaaagggcttgccaacctttttttattgaatggataaagcccaggttatttccatcttaaaagtatgatcaaatatagcagtcgtaagaaaacaggagaccagaagagccaactgcaatagactgtaatataatgctatagactagtttatcagatatctttatcaggaaattattataagattagaaagtataatatttacatttaattgtattttacacaatggcagttctcatgaggaaatataccttaaaagaagaaaaacaaattaaactaacatgttcacatgcactgtatattctggcaggaggtcatcacagagtcttgcagattctgtcctgcccaaggcagccagccaagggtgtaagtgggggacgaaatccaattcactttgagctcactaaactccaatgcctgttgtaggactgggcggttttctaattctctcaaaagcattatatgggctactggtggacacttctggactatttctgtctggtcgcaaattgccttctgtctaatggtctaaaagcagtctgtctctcttagaacaatctatctgacaaaaagggagcacatggctattggccaaagaattgacttgcatttcccagactgacctgatcccaccctcagtccccagaagggaatggagaaacctactcttcactgataaaaattctggtggaaatctggatggtatcagatggtatttagctagggagataagaaatgcttaaatctggccaggcgcggtggctcacgcctgtaatctcagcactttgggaggccgaggagggcggatcacgaggtcaggagattcagaccagcctggccaacatggtgaaaccctgtctctactaaaaatacaaaaatcagctgggcgtggtggcacgcgcctacagtcccagctactcaggaagctgaggcaggagattcgcttgaacccaggaggcggagcttgcagtgagccgagatcatgccactgcactccagcctggtgacagagtgagactccatctcaaacaaacaaacaaacaaacaaacgaaaaaaactatcaggataaatctaattatttatgataaaatttagcataaataagaacagaaattgccagttatagaaataaggttgttgaaaacccttaacaaatatggcagttagtatttttttaaaaaagaaatgcttaaatccttcttttgtccagcaatggccttgttcccttgaggtaccctgtggaaatattaagccaggggacaatggtcaaaagaaagctaaattctacattattattaattgggattttgtaccaaatttcaatacagagctctcaaattttgctgaagtataaagcctagtgctgaagtgtaagaaggccagccaatcctccactgaaactaacattcaaatattagtattttaccatcctcctcccaaccacaggagacagacctgatatgtgtattgagcacacatgagtgaaggcaagaagagtggacgagggacgttagccaggctccatattggtttaggactgccaccaagggtaagggtgggattgggcacctcaaggaaagaatggaatgaagcagagaggaaagtaccagcaacaagacttggacctcactgctcaggccacatggaaataggaagcatgagaaacactgagaagctgccctgataagagcacaggggaggcccagagaaagggccgtgttcctgagtgtgcagttttaaagcagcttgcccctgtcttccaggctatatggtcaatcattgttctagaatatgacccaattggatttgtatattttactattcttgagattgaaccaggaaagggcctatgggaagagacctcttgctttctttattcaggtactatttctgttcttacagatttttatccctattccttttttccaaacatttcccttctttaggaagcacttcatgagtatgtaacttctctaaactatcatgtcatgacatttaaccttaagaagtagagcacagcattataatgtccctcttgttccatgcctaacattctgtgcctatgtttccacatgtaatcaagttgagaacattgcaaaattttaaattcataactcttgccacaagttgctcgccatgtggttgaaatgataggatccatgtatgtggtaacgtgcagcaaaattttaagaaataatttcaatatggaagtatggggaaccctgagttcttttccaggagagattgctgcaatttagaggggaggggaaattgtttatgggaaaggtaaaaattaaactcaaacctgattagtgttcagggaggaggaagaaaggaattgctattagaaagaacagatcttacaaagggatagaagacagaaaatgcacacttgtttgtttgtttttgtttttttgtgggttttctgtttgtttggttggttggttcaggaggagggagcagtgcatattctactccagccatagcagagctttggaaagtggtgagagatacggtaaggcctagccaaactgtggcagctatttaatgttggctaaaggcaatttgaattttatcccactgaaaaataagaaaatctgaggatataggccttcaagtctgactttcggttctcactaaattccaaaatttttacatatctattattattattggaaacattatttctaagctatcaacatgtaatttgtggttcagtgtgtctgggaaacagagtatttctatgatttttgaacttagagtttaggaaatttccaattttgaagcaaatattctcttagtgtcccaaaagatcaagtacatttttttttcttctaatgcttggtctgcaccattccatctcaaatcacagctcatcactgattacacaaatacttacaagcagggcccatttttagtaggtaatgaagtgtaaggatgaagcttaaatgatgcaatatacccaatgtctagccttacataaataaataaagggccatttgtttcatttcacttcaatacacacttttgcaagggaacgttctatttcttttggcacacacaaaaaattctaagtatacatcaacattttttaatgttgaaatatagttttgcttttcctttattctaaaataactatataataaacatactggacattttttggtgctttgttcaacaatgaacaggccgaatttcctccccagatgcctcgtgacattggcatatgcatagcaggaaacgtacacactccaagtcataatcctgtctggataaatctgccatgtgtgctgggcaagccagacctcattcacctgttcatactgacatttaatccatcaccaaaccttacctagggactttctaaagatagtaatctcactgaaggagaaatgtacagattgctactctttgggactattttaaagtattttgatgtttggagaagtggaagaagagaggaagatacaagggaagaaactacacttgatgtagagttaatccatttaagcttcagagcctaccttgtgatgtaagcgttgtctcacctatttccagaaaaggaggttaaagccaatgttacatcacaagtaagcagtgtagataaaatttgaacctgaaaatccctggctcaaagtccaaagctttcaattacacaatcttgtcaagaacgtaaaaacagatgagtgcattgaatagaagaaaagatggcccaaagattaatatttgtaaatctcctctaatatcttggttaaatttaccacccaaaataaacttcaatattgtcatgaaaaaaaaacatatcagttgtcaaaattgactccattgcactggcatacactgcagcttaagatatccaaatgacttagcagcagagccaagcgaatagttgaaaaatcacccactgtacttctaattgaaatagccaatctgtataatatgcactgtaaaatatgacttttccatacagcatttgaagcagaattcagatagattcactactcaattaaatcagccttcatagggtttagacacacttgaattttttggtttaaaaatggtgaagggagtgctcttttatactttgttgttgtcattatgattattgttactttaggaaccatatattttaatctgcaactgcctctgaaaatgtctattcacatttttcaaaaaagaagcaagtagtgagaaaggtgcatttagaaatattaccaactctcaaatctccagtgagcatctgtgtatagtataaaggcaaaatgcagatgccactgatatgttaattatcctaagagaaagaaggtattatgtacctaaatacagttgtatatatgtataatgtgtgtatatgtttatgtttatacacacaccatatatacctaactatactctatgtacactgttacggcttggctctatgtccccactgaaatctcatctcaaattgtaatctgaactgtaatccccatgtttgggggttgggacctgttgggaggtgattggatcatggggtggtttcccccatgctgttctcatgatagtgagttcttgcgagatctgatggttttataacgggctcttcccccttcccttggcacttctcctaactgtggccttgtgaagaaggtgcattggcttccccttcaccttccaccatgattgtaagtttcccgaggcctccccagccatgtggaaatgtgagtcaattaaacctcttttgtttataaattactcagtcttaggtagtatctttgtaacagtgtgaaaatgaacaaatatatatatatatacacatacatatatatatatatactctattatatataactgcttcaagactatttttagtcctacagtctattcatatttttctaaattttcaaaagttttacaaactctgtttctattattttatatataaacaatgttaaaaatattcagagcaatggatatttagggatgagggatgggagtcatccaccctgaggggagatatattttttcatgaaaactgcttagaattgtcagggcctgataataaatgcagaccaactattagttggttttgttactgtctttaaattatctccttaaaaggcagacattcatcacctgcacctagagtagaccacctcaattgctccctcccttggtaggccactagctgaaggccttctaggagaaagtcatcacgtctaagtgtcttgtttccttagtggaactggaagtacttactccataaggctgccttgacaattaaataaattacaattttgaaagtggttagaacactgcctgagatagagcaagcattacagcactgtttgtttaagtaaataaatgatatttatgaaaagcctgatgtagcagtccgccaattttatagatgaagaaactgagtctcagaggaggttaaaaaaaaaagacatcaaacagaaaatgattgtggtttaaagtaaagatattgacactaaacctgtacccattctacctctcccacacaaacgggatcatggctttagtttttattgtgttatccaattattgccttattttgcatatttacttcccaaattatttgtgtacatatttttaacctatagctttatggtatttcagagcaggtgcactgaagtatggcaagagggaagatgacagttattaagaaaaagtgaatttattcaactttttaagctactaaaagcgtgcaaattagattgttattgttattttaagaaaaagaacattatgtattgaaaaagtatgcctttccaagaaaccactaaccagatgttggggtcttgagatatcccaaagggatactggtaaaaaatgatgaaagaacttccacacaaaaatctaagaaagcgcgcacacatgttataactatgaatattgtttgcaaaaatttaacaaatctgcttcatcatcagatactacagccccgggatagcctggtctggaaatgtggtttaaggaagaataaaaatacaaatagaggaaaaattactaggaaaatgttaacacaataaattaagtagaatagagaaggaatgccaatatctaaagtttattacacacatgtgccattacctgtgtggtaatggactattcagtctttgattctattcacaaggcagcagttaaaggctacatgatataatcaatcaactagttatttgacatcgaatgtttattgagcgtttatcatgtgcaggatgtttgtgtgtgtgtgtgtgtgtgtgtgtgtgtcctgcacaaaaacacatctgactatatatacgtatatatatgtatatatagtgacaaaatacatatactatgcatacacattagaagctagatgccattttgactgtttggatttttttttccctgaccttacactttaaaaaaaatttatttcttaaagcaattggttagtttttataggtgatatagccagtgtgagttcaccatctatgaactgtagttttctttattaagaatattattgtttcaaccaatagcatgccaatactttctcattttatcaaaactggaaatgtgtctccaaaaaatggacctattgctttctgaggggaaaatcttttctactgcatatcatccccacttatccatgtatctttgctactcaagtagggcagagccacagagaacaaaagacaacgtcttactttagtgatggctgtgtaggacagagaaccttaaaggaccccaccactctcttacctgtgtttgtttataggggttttgtttgcctgtgtgtgcttgcttaatgctttgcatttgcaaagtaaaagcaaggtcatctctgttgagaagcttgttgggtactccagatggattttgctaattcttgggaaggcctgaagtttagataagtggagactgtagaaaagttcaattcttcctgttactgatttctttagtgttttaactccatctcctagtgggcagctctttgttttatgttgctgggtggatggccattggctctctttctggttttattggaagtttcttcaaatggctgtggtaaatttcaatgaacttttttatcatgctcatttcacttaatttggtagttgtggagttccaagtcaaacagaaatttcaggcaaaatgctcaaaggggaaaaacttgaatccaaatcagcaggacttaaaagcaacactgtgtgtgccgggaacttgcccagagattaaccctattgaatagtgacaggcagctatgacattacctgtcaatgtttgcttctccagagggtcccaagaaccacttcatgctcactgaacccctgcttcatagcttggagcctgagtaattggatatctttgaaagagaagagtaggtgccctcgtggaggcaccatgctgggtcttggcagcagtgtgagggcagccctgaagaggaattatactcatgaagactcctgaattccatctttgtgaaactccattcactctgttgcttgtttctggcaaactgagagcatcctgagaatgggtcaaggatctttcaagggaatccctgctagcaagattgaatcacatttccaaaagcaaactggaacaattttccatgtcagaaaggatcgttatgacaactgtatactgggacagtgggcatgacaggaattggagatggaaacatagttttccaaaagaaaagcaagccctacagggtattaatttttcaacttagctaaggtttgttggctgatcagagtaaatgctgcttctttgcctggtccatagctttttcctgctctttgcctattcttcctctatatgtgagtggtcaagaacattttgtaagacatagaggaaagacatgcaggagtcttggcaagatgaatgggcttgatttatatcaggaatttttactctaaattattgactccgttatttcttcctgcctctatattctgaattaacccaaacaataggtcacctgctacttttaatggcaaaacccacaattacttctgcaccaatttaatatttcagatagaataagagaacttaattattaaagagtaatggaagaaatatattaataggtcataaatctggagaaatatgagaaaaatttaaaaagaaattttgacacagcatttataaaacttccccttccctattacatttttattcttttctttcaacaaagtagattacaaaaatgcagaatattttagatacatcacatacaatagcagagtatccaagtcgagctgcagtgtgtgtaaatcccatatttgtcacagagaggtctgctgtgcttttctacaagtcgggcactatagcaaattcccagttactatgtatgtgctccatagcaccagggtattgcagatatccaacagtgctgtgctgataaattttgtctttgaaaaagaaaaaaaaagtccctatttatagcatttcccattttccatggcataaatacttcccacacagtagacttcaagctaccaactgatgtcactaaacacagagctgggaaaaaaaaatgtgcataattggctcttgtaagcctatgccagtctcccatcaatatacttggaactaggagacaacttagaaattctctacccaaaccccgaaagttttggagtaaatgaggtggaatgatttgtgaaagccaagcaggaatggccaagttgggaatagatgcattattcctagttcaagctcctttcttctacactaaaatacaacttatgaatttgcctgtgcatctgtatatttcaatctgaacaacgataaatgaaaaacagacaatgagtggttggttatatcttaaaaatagatgtaaccaagctaatacattgaagcaggcactggtatttgctgaaatgctatctttatttctccttattgtacttacctcctcacatctgtccatgtcatctggaaacttacaggatcaagtctacactgtacagaaaccaattactgctcagcagaactgagctccagatccctttctgtctgaccacagtgcaccaccaagattttctaatgtggcttccttcagatcagtatgaagcagcttgtatttttagtgaccacagagaaatggctcctttggacttcatctcaatcaatggttgtgtgggtctcagccaaaaagaaagtgattcaaagcagagctccaagaaagggctggatgtacacctgaaactgaaattgctggggagaacctcaatgccaaagccatagccaaagcaaaagtccagccttacaaactgagcaaacatagctgtgtcagagaacagctgtaactgagcttactcacaacaggacttgttcttcttgcaccgaattccaggtttatcacagcagtaacatttgtggcagcaagtcatacttcaagtcctggtggttgttgagtgtgaaggtgttaattataccgcctgtctaggtctgaattactttagaggcaggcacttaccgacacacaacacctttttaaaaacccatagaaatcttgaaaatttttcagcctgaacaggtacctagaagagacattccaacatcaaaactttgggagaaactgttagactatcaggggaaactccagattttatatatgaaaggttgaaagattacaaactttcagaaaggagggccagaattctcctcaagggacattagccctgcaagcatattgttctattgtttagttggaaagcttttcaggagctgatagagattttggagcccacagagattgttatatttcccacagacctccctatagtacctcacctttctgtaatctaatgaaattttcagaaggagacacattaggcacctgtagctgatattattcatctaaacttactcttaaaaataagcaatcttccattgcacatgtggtaacataattaagggtgtcaataatcccttaaaaagacacccaaaagggtttgtatttgaagaggtggacatggtcatccaaaacctgtggagtctaaggtccaggatttaaggttcagcttgcaagtcttgaatgattcgtttgactcagtggttctcacttacctctcattagagttgtctggggagtgcttaaaaaatgccaaggttggcatggttttgttgatttgttaagatactcaggtgactctaaatatacatacaggattaagaacctctaagtcacttttctgattctcaataatattctattttaaaaaggaaaaataacatctaactttcaggaacctacacagacattgcatataaaagttcttcataatcaggaaggatattacatgtatatgtattatctgtgttaattacaaaaaaaaaatagactttgctatatgagaagttctatgtttttacttataacactgatatttcttgatcagtaagtgcatagaactgttctgtaggtaacttttttcatcctttggtagcgacaagcaatctttctttagtaaacgtaagtttcagtgttttgtagtattttattggggacttataagaggaaaaagggtaacaaacagcaaaaatgcttttggagtcttcctcatgaagtctttgcccagaccaatgtccagagtggtatttcttagattttcttctagggttttctagttttaagttttacagttaaatccttaatcttgagttgatttttgtataaggtgaaaggtgggggtctagtttcaatcttctacatatggctagccagttacctcagcaacatttattgaatggggtgtcattttccccttgcttgtttttgttggttttgtcaaagatcagatggttgtaggtgtgtggcttaatttctgggttctctaacctgtttgattggtctgtctgtttttgtaacagtaccatgctattttagttactgtagccttgcagtatagtttgaagtccagtagtgtgaaatcaccagctttgttattttgcttaggatagctttggccattcaagctctttcttggttccaattgagttttggaatgtcgtttgtttgtttgtttgttttccagttccatgaaaaatgtccttggtagtttgataagaatagccttgcatcggtaaattgctttttgtagtatggccattttaacagtattgaaatttcttatccatgaacatggaatgtttttctacttgtgtgtgtcatctctgatttctttcagcagtgttttgtaattcttgttgtagagatctttcaccttcctggttagctgtattctaggtatttaattcattttgtggctactgtgaataggaccgcattcttgatttggctctcagcttggatgttattggtatatacaaatgctattgatttttgtacattgattttgtatcctgaaactttgctgaagttgtttatcagatctaagatcctttgggcagagattatggggttttctaggtgtagtatcatatcatctgcaaagaaagatagtttaacttcctttcttcctgttagcatgccttttattttttttccttgcctgattgctctggctaggacttctggtactatgctgaatagggatggtgaaggtgaacatccttgtttcatttcagttctcatggggaatgcttccagcttttgcctgttcagtacgatgttgctgtgggtttgtcatagatggcttttaatattttaaggtatgtaccttcgatgcctagcttgttgatggtttttagcatgaagccatgttgtattgtatcaaaagccttttctgcatctattgaaatgatcatgaggtttttgttttcagttctgttgctgtactgaatcacaattattgatttgcatatgttaaaccaacctgtgtcccaggaataaagcctacttgatccggtgaattagctttaacggtggactgaataaagaaaatatggtacttatacaccatagaatactacacagatattaaaaaaaaatcagatcctggcctctgcaacaacatggatggagctggaagccattatcctaggttagttgatgcaggaacagaaaagcaaacactacatgttcttactgttaaatgggctaaacactgagtacatgtggacaaaaagaagggaacaatagacaagagggcccatttgaggatggagggtaggaggagtgagaattgaaaaactagctctcaggtattatgctagttagctggatgacaaaattatctgtatagcaaacccctgcaacatgcaatttacccatgtaacaaacctgcatgttgtacaccttgaatataaaataaaattggaaagaaaaaacacatttatttacaagtacacagcaagagaaaaaagaagagaggctgccttaaaatttaaagtacttcacaaactgctggtagcccttgagttgagcatccaataggtggtgtttcaatggtgtatttgttagagataagccaaccttaaatcacataggttagaaataagccaaccttaatgattaagaacgatgactctggagtcagcttgcctggagttgaatcttactcaaacacttaacttcaagtgtggtattaattgtacgaatgataattatacctaagatttggaagaggatcaatacatatagagcattcattatagtgcctagcatatataaagtcttagcaaatgttagctattattatacactaacacagtctcgaagtcagtaactagttaatacaatttgcagagtgcctttctctgacagactacagggtattctcttttggaattaatatacagtaaaaactgagtaatctatggtaacgtgatataattgtattatttttgagagtgtattaatttattaaaaacaagttattagacacaaactatgtgccagctactgtgctaatgctaggttacaaaaataaatgatattcctttaataattcttagtttagtgggctaaatagacaggtaaactataaaaacccataactgaaatgtgtgcacagcactgtgaaaacaaaagtaaaacaccctaagtagtcgggaaaggctccacagaagggataatttttaaagcaaaccttaaacaaagtggtagaagacagagaaaggaagatactaaggatcaaaggtgccaagtatgagcaacgttgatgaaatgacctgaagatattctccaagttcagattcctttgtttgagttcagatccctgctgtattgaaacaaaataggagttgctaacttcttcacatgaattcttcctcttttgtgcctattgttaaagcattattgacataaaaggccaaaatgctagcaagtacctttctgtgtgcactgcaaaatccctgggcagcaaaactttcaagcaaataattcttaaactgaaataacagtttatacttgttgatcatttgggagaattataatattaccaatggtacaatagactatttgtaatagtaataaatagtacgatagcacgaatcatactatagtacgatcgtactatttatttttgctcaagattgtgaataattgacactaacattgattattcacaatcttgagcaaggataaaccgaaaaaagctttgacagagaaaaaaatggtaggaaatgttgaaagaattcagattctggctgtgcatgctatttaaagacttcattccaagcaatactataatctctacctaggtttttttttaagattaaattttgtattataggaggaactattgatgctgttctttacttttccccacaactttaaaaataaatttctttgaagtaaataagtaaaatgtctgaatcccaactcctttctaaattttcagtgtcttaaagaatattttgggaatctgttatatatttctgggttttggtcgacctatttaagagtatgaataagttagacaataattgccagtaatctatattaattgtttctcaagtttgctcaatttataatgagatgaaaatttttttatgaagaaactaattcatattttcacaacttagtttttagtaacatgaattgcatacaaatcataattatgagtaacaaacggtggtctcaacagctttggataaagttcctgaaacaaaatattatacagtatatctgagaccgggcaacatagcaagaccctgtctctacaaaaacttaaaaagaattagctggacatggtggcatgtacctacggtcctagctacttcagaggctgaggtgggaggatcacttgagcccaagaattttaggtcatagtgagctatgattgcaccactgcgctccagtttaggtgagagagcaagaccccatttccaaattattttttaataaaaataaataaataaataaataaaacaaaatatcctagtcaatgatcaatatacctgaaaggagtcaggttccattttgtaaacagaagcttattctgagccatccttctcaaaacatcttagctcgttgtcatttgaaaaaataccccaaaccgcctgattataccgttcctgtacaccacttttatggactttgcatagcatagtctctagagtggacctgctttattgcagaattttcaacgcacacccgtgaatctgtaaagagattgagacagtaacattctgtatcctggcagagattagtggcagagccgaattgattggctgaagagtatggagcatttcctgtgttattttcctgctgctaaaaactctttctgcaatgtatggatcaaattaacactagaagttactcctttaatttctttgatatgaaatagtaaagtattaccagaagggcagtttcaaaaatcattattgtacacttttgttcaaaggagcctgacatattgtttatttaatttgaagatctatggctatatggctgcatacacagtggaaatacatttattcacacagttaagatagtctctgaggattcagatggagcaaatggacccaatatttcaattctacatcctttatagccatgatgacccagtactaatatgactttctaaagcacaaatgtagtgatatgaaaataaaaatttactgagcctggaaagctgggttctaatcatgactttgctactacctagcactgttaattgcagccttttatttctgtaaaaaatgaggacaacatgttttcttcctatctcttgggtttgttctgatcatggcaaggactacgtgctatgtctgactgcccagcaatagtccttggttttctttgagttagatctaggtctgccatgcataacatgtgggagtgcggttatccaaagttagattagcctgggaaatgaagagaaggataattctgcagggggacgggaggagtaaatttggtatgtaaggcaattacacttcacaataatgaatgtgacaggaccttgacaggaatagcaaattaaagaagattcttagtctctgttagttccattgcacatgttccactgggggctcttcacatctccagatttgagaattggcttgattttcctgaacatcttttgtctgtttcagcttacagtaaggccaaacagaggataacatataacaaaaacaattatatactgccaaagtaaacctctgtgcaaaagagtaggtttgtagctctttagaaacatataaaatataattagggatatttagggacatatatatgtatagcacagagtaaattcaaacaacagcgttttagaaaatagttgtggctactccctccatctaaaaatatttttgacccaggcaatgtggcaagggtgctgtaccatccctctgtacattcttcattcttacattccagaaatattgaaccataaggtttcttcctaaaaaaaaaaaaaaatcatgctgcagtaagctctttgagagcacaaaattggcattttattgttcctacttcctttccaaaatgtctggtaaattatgaatttcaaagcctgtaaatctaaactcaataactgcattccctttcaggttaactggccaaatacaacaaaaggtgaattacccataataatttttaacacatcattcactcttcaataattcctagttccttatttttaatctaatactcagaaaacttatttccaatatcagtccacatttctaatatgtatgtgactattagaaaggggcctgcaagtataaacttgaagtttatgaaactgagcacattggaacctaatactggccttgtaataaacaaaaatatgcacttgtttatgattggaaagcaggacgtaattcattgtgactgtgagactctgaccattcagttcagtctggtttaaaatattgagctgaatactctgaagcttgtcttgtgctgagtacagatactgagatgagtgttacaaagtgacgttctgaagctaatgaaatagttgatattgtattgttcaaaggtggtaaccaaaatcatacgtgggattaaatcatcagacactctgtagtttcaagaggatccagaatgaatcctcaaagaattgcttagaaaatggtacaggatgatcagaaaatagaaggagggttttactattcatgtatttaataaacacataaataggagatttctgtttacctggcattatttaaaatattttacaaataataactcacgtaattcttagaacaactctttgaggtaagcactaccattatacccatttttcagagagaggaactgagtcacagaaagattcagtgacttgctcaagatcacagatctagtgagaggccaggctaggttctgaatctaggaagtctggcttcagaatccatggtctgctgcctctgctacttatcccttcattattaaaacggagggacagaactccattattaaataactccattattaaaactctgagccttgtgactcagagtcccaatgtgtaatatttgctatcattaaacatttttaaaggttgtagatttaaattggcataccagttactaggtactattgcaatgaaaaaagttttaatttaaaaattaattactactaaagacttactttaactcacaaatgtagatgtccaaacccagaagaaatctgtggccctaagatgtatattttcacatctctggttcccatcataatgtggggctgaatcttctgggtatgggagagcaagtttctccgaaaatgtgacagtcatttttttgtctccggccccaggccacctggaatcctggcttagtctttttattttcccatttatattttgttaatttcaaaacatatatgtgtttattatacattcatgtgttgggccaggagcagtggttcacacttgtaatcccagcacttctgggggctgaaggaggcagataacctgaggtcaggagtttgagaccagcctggccaacatggtgaaaccccgtctatactgacaatacaaaaattagccaggcgtggtggcaggtgcctttaaccccagctacttgagaggctgaggcaggagaatcgcttgaacccgagaggctgaggttggagtgacctgagatcatgccagtgcacaccagcctgggcgacacagtaagactttgtctcaaaacaaacaaacagacaaaaaaccatcacagagtgtacttacagaatcatagatgggatagcctagtatacacctaggctgtatggtatagtccactgaacctaggctacaaacttgttcagtaacctgtaaccacatgttagtacactgaatatggtaggcaattgtaacatagtggtgtgaatttgtgtatctaaacacagaaaatgtaatgcattgccctatgatattaccacagctacaatatcactaggcaatagtttttcacctctattataatcttatgtgaccaccagggtatatatggttcctcactgatggaaatgttgttatgtggtgcatgactgtaatagctgtaatcattcaaagttgtatttttaaaaataataatctcctccattctgaaacctttgagctaacagcctgatatcctggtatgcgaaatcccataactttctttatgtttatacatataaatatttgtgtattaatttgttttaaaatatccttgaggataatcttgtatataattatatgaatactggcatttttattccagtaggatagatttccgaagttatgtgtcatattgcaatcccgacaaatttcttttcacaataatgaaataaatttgcacccattccagtgtattagaatatgtcttttcccatatgctcaaaagcactagctgttacttatctaaagttttgtcgatctggtagaagaaaaaaattatattttattgtcattttaatttctattttgactaataataaggatgagctcctgcttattatcatccattggggttacagatttactgagatcatgatgttcttgccatttgattaatttttctcatcagtttgcaggcaatttttgtatatgaaaaatattaagccattaacacaaatctatctttattttttactttgtttatgtcatttttgccatgcaaatatatctatattggatatatgtggcttctgagtctcccactttccttaggaatattaactctactcctgttcttctcacaaattattttagaatattttaatgggattttttgtattcaaaattttaatctatgtggaattagtttcatatgtggtataatgtaattttattcattccagaagaagagttgtttttgccaaactgttcacttggtaaataatctttttattactgaattgaaacgccacctttgccatatatgaagttcccatatgtgtgcggatctatttctggtctctctgtttcattccatggatctctttgtctaatctgaagccaaactatattgttttgattatggcagcagattccatctttttaattgactggagtctaacaatgggtaatagtgactatttgaacaagttatgcattctgtagagtaaaaaagttggtgttcaactcagaaactatacaattttcacaccaatcatgttactttttcatgatttttttcccatcagtgcatgctaacttcttaactttttaagctgtaactatttattataagcattattttttaaaaaacatctgagtgtgaacattctgaaaaaggcaagactatagagaacaaatatagatcagtggttcccctgggcttgagagggggagaggggactgactgcaaaagatttggagggtactttttggatgatggaaatgtctatatcttaattttggtagtaattacatgacattacatttgttggagctcatcaaacagtctacctaaaaatgtgagttatattgtatgctaattatatctcaatacatacaaatttaaaaaaattttaaaagtgaatgtgaaatatgatctttttaaaaaaaattagggggatgggttgggtgcagcggctcacgcctgtaatcctagcactttgggaggtggaggccagtggatcacctgaggtcaggagttcgagaccagcctgaccagtgtggtgaaaccccgcctctactaaaaatacaaaaattagccaggcgtggtggcaggcacctgcagtcccagctacttgggaggctgagacgagagaatcacttgaacctgggagacggtgtttgcagtgaactgagattgcaccactgcactccagcctgggcggctggacgagactccatctcaaaacaaacaaacaaacaaacaaaaaaatgggggatgaacctgacctacttcctgcaatagatggagcaaccgtcttgacttggctttaacctgctaagacaaaacaaaagcagaatcgtaagtgaaaatatatagggactcctgccactaatgcattttgactttcagtctttggaagtaatccacatttgacctgttttacctctgcaaagatttttagagcccattcatcctgaggaaatgatacaggtttatagattttattacagtgcccgcaagcattcttgggactgtgaaagataccggtattttcctaaagctaggggttagagctggagagctgatcctcaggagaatctaagaagcaattttccacttgaagaaactgagattgtttagttatggttggcagaaccatggagctacagtgttgtcattcccactttctctagttttgatcaatgcattttagggaaaactcttctagttgactcttactagaatatacaagcaagaaactaggctgtctctcagagaccagaggtaagaggcaagaaaagattaatgagcatttttgcagaaagccagcgccagtctcagttccagacagaaggccaggaggttcagcacagtgatctattgaaatagccctgatggtacctacagatttaatgttatcagagtttatcccagaggagttagttttcagagtcagaataaggagctggggggagggaaggagactaagcttaagagatatcatgacaaagcgcctgctttttctcacttgtgaaaatgtaggctatctggaggtaacatgataggagccatcttggattagcagattgtcactaacgctatttatccacatatcctgaagtgcagaataaatctatgtgatttttattgcccaaaccattcagtcttcaggatgattttgttaagatttcctttctgtatttatatttatatttatattggattacattaatttttgtactcattatttggactggataacagcatattaaagcaacgtggaacattaataactcataaaaatatgtagctcttcctagagcttccttatggatttttttcctcttaaaaaccctaaggataattaagtttgacatagtgatccagttattttttttaaaaagcagtagctctctatctatagattgaagaatatctagatgatattataataaatgccataaggtaatatagaaaagagcactctgcatgttggaactgtccaaaatagagtgagctgccttctgaagaggattcctagaaatgtccaatgtgaatctagaggcttttatctgtttttcatttattcaccatgtcttcattgagtacttacaaactcttaccgagaatgtagttaagatatttcatgctgggggataggactggactccatgacctctatgatttcttccatttctatggtttttaaaacatatattttatatttgcatgtgctacatgtgagtatagactatgtaaggatcaagtcgaggtatttatatcaccttgagtattatttctatgtgttggtaacatttatatgcatttacttccatgtttccatatttttgttaagaattttcagtgtattacactaggccatatataatccacaagtttcatgattctacttctgaatgatttctcactgtatctttgccaattaaagatgacggtaaacatctttatgagttttcattgatttatggaagtctaacaaaaaatggcaaatataaatacccctctgtaatatttcactttggcctgaactgtaaataaggatattttgtaatatctacaactaagatatgttgtcacttctatatgttaggaaataagtttaaaatatggagaattatttatgtatgtgtttctttgaagcataacatagatttcactttaactttgtcagttataccattcaaagacataaaatcattagttctcaggagcaggaaaacagttagaatttccaagaaaaagataggatgtacttcttcatcattgaatgcccagagctagacactggggataaaagaattggtctcaaggagattatcaaggcatttttcctcctcattctttagtgagtactctaattcaacaacattagaaaagacacttatgtcctgttatgatattaggaaaagtgattactgggatacaaagtgcttcagaacctgaatggtaaagagaaaagcttgtctcagtagttactatttgatggagagaccatgatctgtttattcttttgatagtgatagagctaatatataatgataacttgatgaccttatcaactagtagctaaggctcttgtctactttggtaacatgacaagaaaattagagattgactaaacatcatgctgggaaattcaaggcaggcatttgtctatcttcagtatggctatttatcctatccaattagccaaattacttttcattcatctgtgcattttggcccttgtagatattgacttaaaacaccaataggcatttaagtccagattctcaaacccaaaataatcacaaaattattataataggtaaaccaaaattatctttagaaatgggaaaaatagagatatgtaaggacattaaaatcaaacataactaaaacccgtcctttttagttagccttttttctttttcttttcttttctctcttttttttttttttttttttttgagagagggtttcacttagtcacccaggctagagtgcacaccatgaccaaaactcactgcagcctcaaactcttggacttaaaggatcttcatgcttcagcctcccaagtagctgggtctacaggccagtgtcaccatgcctggctaatttttctgtacgttttgtaaagacagggtcttgctatgtagcccaggctggtcttgaactcctggcctcaagggatcctcccaccacgaccccctaaagtgctaggattataggtgtgagccactgcacccggcccttcttttaaaacactgactaaaaacagccaatacttacagttttatttcctactattttatgagattgactaaaagtaggtagaagctgttgaccggcacttcagcaactctcctttctatctagtagtgaggatgttcagtaagggatgtgaacaaatgttgagagcagaaagaagaaagggatgctgggcagggaactatagacctgtccttagtaactatagagctgctgtaccttaaatgactatttaatggcccaattggtaatttttgtcacttgctttcaatttcttcagtaatgacatgagttacccgtagaaggaacatgtcattactttgctttttaagttagcacaagactactacaaaaccatcattcctagaggaaatatgcatatatgtatttatttgtttctcatgtctttctccttctgaaaatgtccccaaggccaatgtgccaaggatacctgaaagccctagggcaagcaatatgaaaatggtaagaactggaaaatgttaggctccaataaaacaaagccagatgcttttgactcatacaaatatttcccttttcttagggtaacatgaggggattttttcccctcaaaaatgttgcttgtgtgtgtgtgtgtgtgtgtttaatttccatccttatataagtcacaagtctgtgataactcacaaaaataccagctgtttcatgaacagaactttgttgttgaaatggttttcaaggatcacttcttttacagcttccaaatcatggaagctatatccaagttggcagctctgctttcttctaaccttaagtagggactggggagaccggggaaggtggtcaaaagaaccatttgggtctcagaaccagcaagtcaactcttcatactggaaacattttcccatttgcttccatttttcttaccccttttcagtcctataatcttgcactggggtctgttgaggtcatattattagctctcaatggccacatagaaatccaactagtggagtcccattttttcacttaaaacatttccttctgagcaaaacctcatcaaatgccctaaaaaacctacttgttcatacacggaaggactttggtttcctatgattcaaataccaaagttgaaacaaaactaaattgaattattaccagattatcagggtttggctgaatctttgccctgtatcatgatgcagacagattctcctgaactggcttgctcccaggtgctgacaataactctgagggtattatgggagggatagaagtgttaagtatctctggatgatttgtatgtattttaagcatgcagctacctgaataacccacagtcaatatgcccaaaagagtagaaacagtttttacaaattttgttcttattttatgtcaggactttgattccattgaaaattgtaagttttagaatagtttttgttagtgggtgataggtacattttggttttcttctgcttttgtgtgtgaaaatttctggcaagtcaatttgaaaaatgcaatttaaatttaaatgttaaaaatccattttaagccctattatttcaagaaaagcatgaggactttactcaaagatttgcttggttgtaaaggcaaatcatttataagttttaaaattcttttaaaatttaaatataaatgttaatttttttcttttctatttttttttttttttttgctaagtgtgaaaacactctgtgaatcaaatattttgtactttttgcagtactcacaagtatggaagttctgctgatgggtcatataatccttgctctggtctcaaagcaaacctaaaactgttctggacagagtggtacctagctttttaaagttttaatctccagagaaagctaagaatacattcatgtgctattacaaaaaccaacatcatttcttattatgtttttcaagtctgcttttacagggtggaatggtaaaacaaggaaagattacctttcagagaaagagtaatcgctatttctctaggaatgggagcctcagaagacactgggacattttcagtattccatagctctagatgttctaggaaaatcatgagaaagattcttttggagctatttcagtggctgtagtacttagccaaattagggtgtaagaagttcaggtaaaatataaaagaaattagaaatgtgtttaaaccaagcaaacaaatttaaaaacccacacttttcggaacctccattcgtattccagaatatccaactttcactggtattctaatattacttctattggtaatagtgtcacaatcggtgggtattactaggggtcaatatttgcacaggagaagagggggtcaactttaggcctgaagtcctcacttcatctcctattccagaagcttctcttcatgttttctgaccttctttctgacctataccttctccatcatcaacaacagtcttttctagagtcagtgacataagtcaaggactgtgataggcttggagatggttggcattttaaagaaactttctctgaaaacaggacttggttccaagaatgttataacatgttaagtaaaaaagttatcagaataaaggcttgtaattttcattgtactatcaaaaactattttctgctctggacattaattagtatgaagagatacacacttctctcccaaaattgtttatgtcagtctcttaattttgacccattaaaaacgcatcatttaaaatataggtgattcacggtctcacagagaagaaacagtaaaggcctttcaagatcctttgcacaaaggaagggtatgggcctgtcataggatagtggctgagcccggctcctgattccaaccctctcccaggaatgccccagggtttcagcctcaaaccctttccactccattaaaagaacatgaatcctgataattcacatggcacagtgatgtgactcggaagagtcaacacagtggtcagtcacacccgcaaacaccacaattgccttgagatgccaatctcactgaactgaaggagccaggtgccacacttgttgggtagaaagggcttagaaaacatcagggtagttgagatgttgcgacacaactggcccgcattacaggagagttcagcatgaaagtataaattagagcgctaggtttctctccctctagaccccatcttaactagaaacacaatagagccacatgcacaccatcaaaaggagagtgggactttttcttaacatgtaggtatttattaaatacaaaccaattctgttccaaactctttttctgaggtaggacagtgatcttctagcctccatttgtgggaagtcatgtcaggaaagaggagacccagctcctttcaaattgtctacacaaatacatttcaaagtacatttggtaagttaagtctccatccccaaaagaacgagtaaaacgaacacatcttgatctcacaacaaagtggatgaattcaatagtactttttctggacaacgttccataacaacaagatgtttagttcagtttattccctgctatagtctgaatgcctagaacaatgccttccacatagtaggtcctgtataaacaggtgatggacacatgaatgaaagttttttcacagcagtaggcatcaagcgtcactgtccattggaaacaataattgtcaactaggaaaaacaggaggagtccaatcactgcttcctcagcaggcagcagtattaaaacactcctgcacttcacatttctttcttttttttttttttttgagacggagtctcactccattgcccaagctggagtgcattgtcgtgatctcggcacactgcagcctccacctcccaggttcatgcaattctcctgtctcagcctcctgggtagctgggactacaggggcctgccactacacctggctaatttctgtatttttagtaaagacgggttttcaccatattggtcaggctagtctccaactcctgacctcaggtgatccgtccacctcggcctcccaaagtgctgggattacaagcgtgagccaccgtgcccagcagatatttctttttaaagtaacttgaaatgtaaagatttacactagatcatgctaggaaatggcttatcggcttatcttcttcaaaaacacatgaatgcaacacctccaccccgcacacaccccacaaatgattgcttttgacacaaaattccactttctaacctttaatcctgctgttaaaacgttacttttggaaatgtgttcctggtgctcctacaatcagctttctagcttgctgactggcatagcgttttgagtccatagactttgctttttgacaaccaagaaccacataaaatattcaaaacagtctttattgtcagtacttcttattcatacaccatttttctaccgtttagcacttcattttgggtaatccattaatagcaagtgatcttctgtcactaaacaagaaaaaaaaaaactgtggactatttcatttccgcttcttgtcattaattatatttttttaaagtgtaacattcagatacaacttcttttctctgttttttcctccaaataaaatactctcacaggaccactaaaatgtgagttaatcaaagaaccactgtaacaatcttagctgtttctacaggttggaatagtcatttcattttggtagcctttatgctgttgagtagatcagagagatgagataatacactaaagatctgaagtgacctgcttttaaatcctcaaaaggttaatgcataactgagggcaatgagtgggttgattgataggcattagccaaagagtaagatagttgaacttcacataaaacttccattaagttcaactgtcctttgatgcaggattattttatttgctcttaataatatgatgaaattccttgcggaattcagatttgaatgtacacataacactgcaacaaacatatatgtttatatggatataagatgtgtgatgtttttagatgtctctcaatgctcattttatggattctatttctctaaaaaaatcagtgtgtaaagatctaaaaattttaaaaaggaattcacgatcagtgctcaaaactacaatatcttggaaatgtgatgtcctttttttgccttcatgcttattatgttggataaaataatagtcagacaatgggtccctaattttgcttccatcctcgccacctccaggatttaaaaataatgatggaaaaattcaatcagcacattgggtgattaatgtctggggtgataaagagcaaattgcttcattggctgaagaatgggactaaaaaactataaaaactcatcacttctgaagatccaatgcttgcatgctatgttgatttttaaagaacaaattggtatttgagtagaacaaactcattttttaacgcactgccaatcctaaggatgtttcaggttgagatcttctgtgttgaaagtccacactgactcatcactgtaatattatattccagcccaatttgtggttgcagcaaaaagataaataacagatgcaaaggcaaaccgagtggatcctagagacccttaaatacgacaaaatatttgtccagataaagatctcagacttattattcatttcttcacttattagataaatgtgtatttagcaactaatacatatcagttactaagatagcatgggagggtacacagaggaagaaagagcacctgctcccatgctagcactagagagttctattaattttacagctgttaacttgtttaagcctcacagaaacacaatgaagtggatatttttatacccattttacagatgagccaactaaagaagtgacaagttaagtcactgccttaagcagaccaagtagtaagagtgggcagaaacctaattgatgggtagcatatacctctttagtccatgatccttaatctctaaaccactgccacaataaagaaatataagaataaaaaataaaatcataaattctggttatgatgttcttaaaataatttatatttaaagttattctaatctttgagccaggaattacactactaagaatttatttcaggaaaacatttggagaaattgataacgttgtacatttagtacatttagtaatgaacatttcagttttgtttgagaggatgaaaaattggaaataaccatatatcagttgaattgcttttggatacaggtgagaataacttgattaaagtggatcaaccaatagttgtttttcagcccataggaatttctgaaagggagcttctagagtgtgttcagtagttcagaaatgtcattaaagatccagaatcttttattgttaaaactctgttatgattgacatagtttttttcttaggtttcattcctcatggtcacaagacagctcctgtagctccgggcatcacatcttacacaaagacaagaagaagggcagtttctccaagcatgtctatttttcatcaaggaggaaagcctgttcctggaactttgttatttgcgatgattagccagtttggggactcatacctacaccttagctgcaaagaaaactgagaacgtgaataactgttattcggcctctattatgggaggcaagatttgccaacaagaaagagggagaggctaattacactggcaatcagttgggcctggcagaaattttggtgtctaaaaatgaaatatccgtatagtagaatcttatgctgatatcatcaatgatgataagggtaaagggagtatcacatgaaaaaaaatcaagttataggaaaactgatgcacacaaaatatatacaccaaaatgctaacacctgtctctttgtgataggattagagggatattttagtttcattgcatttttacatactatctgttatttttaaattagcataagatgcttgtactattttaaaaatagggatcctttccattttgaaaaacaatttaattcaaagggaaaaattattttatatcaaaatatcaatgttccttggctctgcttgaaagcagagagttgagtagtgaaaaaatgaacaagatatttttatcaaaatttgttttgcattactgtcatgaagaaatgaaagacaagaaagaaatcaagcaaaatggccactggagaattttaaaattggaaaaataaaaatgttttgttaagagatgatgataccaccaaaagccttaaataaagggctgttgcaacttaatatattggatatattgctctatggatttctcctcctgtgagaatgccttccactcttgccaagatcagcttcgtgccggccacaaaaattaaaatattttaaaagagaacaaaaatactcttattttgtagagagtaattcacagtttcaactagcctgatgatatctgccaatattttagtgtttggttaaaacaaatggctaacagttttcttgagtcactgatcattttaaatcattctaattctatggtatacataaatacttctcactgcaaaaatttcaaacaccatagaagaataaaagttcaacccgaaatccctgtttcattgcctccaaagatccttggttcgtgtccctccaaagagataaccactgttaaatttaagatttatttcttaagatattttctatatattcagatttttttaaacctcagttgaatcatactatacaaatggttgtgccatgtccttttttaaagatcatatgtattggacatctctctaagccattacatgtagatctctctcaactattttttagcagctgctaaatctgtttaaacattcttcttttgatggacatttagattgtccccagtactttgctattataaaagatactgcaatgaacattttgtacatcaattttattcacttgggtagatgtgtttgtagaatctgtcctagctgtgaaattgctaattttcaaggtgtgttcatttaaaattttggtagataatgacacactgctctccaaaaagactgtaccaattacacactccaggcagcagtgtttgaagaggactgttctttctatcttcagcagcacagaacttcagcaaacgtggagggaaatcattgtgattgttttaattcatatttctgtgaatagtagtgacattgaacttctttcataaatttactcaagtaaacatttatgctaatagcagtaccttgcatttatattgggctattatttcttgagaacaccatgggttgatgattccatgttatatcagacatattcatctataaaaaatatatattaattgtagtaaattttttaaatgccagtacatatcaagaataaagaaaaaatcacctacaattataccacatttaaataattgatattacagttttttctcattctattatatgcaattatatatgtatgcatataatgtggatttttaatatgtgatgtagctttattatatgtagagctatataggaggtatttgtttataaattgagatcgtactctatatttttaatattctttttctccttaatggtatattgcaaataaatgtactatattatgtttttatattgcaagttgaacatccctaacctaaaaatcccaaatctgaaatgcttcaaaatctgaaaatttttgagtgctgatatgatgccacaaatgaaaaattccacatctgacctcatgtgacaaatcacagccaaaatgtgatcaaaacattgtttaaggaagaacattatttaaaatgttttataaaattacccttcaggctctgtttataaggtgtatataaaacataaatggattttgtgtttagatttgggtcccattcccaaggtgtatgattatatatatgcaaatattccaaaatcagaaaaaatcagaaatctgaaacgctcctggtcccaagtattctggataagagatattcaacttgtaattagtcttcacactattgctatcctatgactatgtcataaatgtgttagccaggtctttattttgtgttgaacttataaattatttaaattttttatttaaaataaaactgtaataaatatccttgtaagtaaaatttgatattcctctcaattttcttcatctactgtaaatcaaattattggctcaaagagtataaacattttgaagtcttacaacttcaactcatattttaaactgtgtgtttgggtgtttatgtttaaataatttctactctcaccagtgatgtttgagagtgttcatacttctatgtccttgaaataataggaattaaaatagtttttaatctttttcattaataattaaaatataatatgtaattggcattcttatagttaaaattgatatgaaagattttatcatatgtgtttgagtctaaccatttgtatttattccccattaaatttcttcatcatgttctttgtctttttatattcagttgctatacactttcatgttgattcatgaaagctctttacatagtaaagacagtaacatctgtcttcggtttctttcattttttaacatttatctctttaataaatctgacatacacacaaggtacagatttaacaagcaaaaatgcatgacaataggcattaaaaataagtattttaaaaaaattggcctagatttagaaatcttgttatatatatgtgtaatatatactctagagtgatattttcaagttattagaaatgaccatcaatagctaaaattatataaaattcccttttgaggatcccagaatcaaactacatcaattagtaggatctctgagaaagtttaaagtacctgaataaaatataagtatgtagtctttcgagtctcatattatgttgtggagtaagataaggaaattcaaatcctgatgtgttgtgagcgtcagcaaatacttttctgtgctccctttttgtcgtttataataatacacatgaagaataatgatcataactatcttatatggtttttaaaataaattatgtaaagcacttagcataatgattggaataaaattgttactacgtaagtcatcatcatgaatgttaaataattatttttatatttacaaagaagtccttctaccattaaatcctcaaaaaaaaaaaaaagcaattctacataaagtctacctcctttaggaaattccttaagtcagtttatatgtgatgaaagcctgcagtgtattggtcttttgagaaagaccatctttgaagtgttggtgactcagattgatgtgttccttcctctttggtgttcattcttagaccttggacaattgaaacagaaaagacatggccagagggcattcttctccacaatgacgcttccacagatttgacccaaaccatgcatatggccctcagtaggcggattttatttaaatgaatgagattgttctatgtttaattcatgatacaagcatttaaaaacactctgatggagagggcagatcaaaacagaactcaatgtagaccatgtttttttttttgtaaattgctggcagccctttataaaatgatagaataccaaaatgcataattcaaaaaaatctacatatttaaagctgtatgtaaataccgaggatggatgaactgcttttgaattttcactcactactttgtgactttcatttttgttcatcattgacatggcttcatgcacaatttaaaagcctgttttcaaaagaatggggatggaaatgttgtgctttagtgtcttgagaatctggcagcctacctggacctcattcaagggctctgcacccttagcccattgcagggaaattggtggttaactatcagagaggaaagaaaagacaacatgaaagtcttctcagaaaaacacatctgagaaagctcaaaggagtaaataatagaaaacagccaacactcagtcatttggggttgatcacttggtttgtttttctttcctctccctcctactccctgccttttggtcatttcactgctccttggcacttctacgagaggcggtgtgtatgcagggtcaagcaggggaagggagaagatcatcagtcaattttgcatcttgctagttgttccagagaaagattggacagaaagagatgaccacaatgaggactggggattatctgtaactttcaaagaccattgttcctccattattatgaaaactcagcagtgggctgcagcctctcttttatttattcacacatatggagaaagcgaatttggtaagcactggcatatagtccagaactcagcactgaaaataagagtaatgtacagaaatgctattttcttacaaaaaaataaaaatgatttgggtcaggcccaattagatatagtcaaaatccagctgttctcagggtttatccagcattagtaacattgtggtattacaataacaatataaaatgtgctttcagaggtgtttttccatttaattcactaacttctaaatgtttgctattttatccatatgtttctagtttgtgtacatgggatattttgtaaatgtcattttgcaagagctatttgatgttcaagaaggctctttggttattgttagaaagcagaaatcatgatttgtagaggaaaattttataagtttgaaaagattgcttttgaggttttgcttcccttcatttcccttgatgtattttagagagaaaaatgtgttcctccgtctgatactaaaaagagtcttcgtgctgaaagtagaaaaacaaagtaggagatagggttgggagggtgagggctctgctgtctttatgaactgctactgttcaaagtcaacccatccaactccttgagaagtacaacttcagcaatgaaagatgtttaaatagtgataatggatggcaaataaaggaactcttatctttggaattttggagtagacacaagcaagcagtgcagatttagtttaaggcttacccccaaagctgaactttcatgttttatagatcagtctctgcttatgtgcttcaagaacacacaatgaggctttagaggcttggctaatcacatatcaaaataaaactacagcactttatataaaaaccagtaatttgaggtaagattattttctgttttcccacaatcacagtgtcaggtgaatgaggacatgagacactatcacttaaaaagtattacaggcagcagaataataaattatactccaacatttatgccttcatttgctcattcattcattcagcaaatattctactatcagtagatcctcctcaaatttggaaagctaaagtaaaaatgatcatagacaaagcttatttctattattatgcatgcaactcctctctgattaatccaaaggcaactgatagatgaaaaatcaaatggcttcagatgtggcaagaaatattcttatctgatgcaaaggaattgtttatttaaaatagccccaggctttccttctaactgttactaaaccagtggccccaaagtcaattctgtcatctctgattaatataatagtgtcacatttccatcaagaaaatatcactcttgcacagagttcttagcatttttcacaatcagactttcttactgcagcttgtctgttgagcttggattcccagagcgcaacattctgtcaggttcaccaatgggactcaggccagttggttctggacagcctcgctccaggtcccacagtccccaggacccaggctcagtggctctgttctagtctgttcatctctgctcaaatcagttcagcttgaacagcagtctgggctctcagttatcccttccttgagaagttttctccccatcaaaagtccctaattttcttactgctctacttttaccttttcatagacagactctctaaacaccaagtcagggccaatgagattataatattttttcctgaacatatatttgcattttaattatggtcattttcatatgaaaaatgccttttttttttgaagacttttctgaagtccattatctttagcactttatttctttctaaagtttcggaaccctcacttagaattcttgtatttattttaccttcttttctgtttaactagacagtgggcctcatgaaaagtaggaacataatgattgtgtttatttgtgggtcctgtgcattttgtataatacctggcatgtaataaatatatgtgatgaatccatccatccatccatccatccatccatccatccatccatccatccaaccatccaagatttattgagccagatgctgtgctaagtaataggaaagttatgccagacccagggggaaataatcagggccaagtgggcctcttgatgcccttcaaatcacactccactggcagctgcttacacacttgtgcaggccagcctggacaaaggtcagaggggtcaagcacaagcaaggacaaagttcacaaatcagtggctcctgacaccatttgaaactgttaccttcaacttcaagggtctaatactcaccctgccaagaaaccttttaacgctctaaccccatagtttcctccccagctagtgtcccactgcaattggcagattttaggactgatcttctaagaactagaaagtccctaggtcaggtcctaaggctctggaatgcccttcctcccaagtgctgctttcttctacacaggccaacatgctaaaaggctcccttttacccctacagtccgcaggtgacctatgagcatcaaaaacttgtgttttctaaacctctatttccttcgttctgcagctagacactaattgttttggtagaggaaactgtcttgtctgaaaagctaggttatttctgacctctgaaatcactaggaaagggagactgaaaaaatagattaaatcaactcaaaccctctcatgtttcattaattatatataaaagtaactttcagattatgactaaaataccagaacatgtgacttaacaaacaaatggacaatgtggtagtttctcctgcaagcgcaaatatatggtcagcataaaatatttaactattacccattaacaaagtgaaatcttagcttttttaaatgagatttcagtaatttgcagttatatttctcaaaaactttgcccagttaccatttgtctcttacttagtattattaagctcttgagcttcataaaatgttacataactgtttgtgccaagtaattcctattttaattttttgtaggtctctacaaccattcttattttaaagatatcatgagctaaataacactggtttctgtggatttgaacaaaatcataggataaaaactcaaaatcctgaggctttgattgacctttttaacaaatatttaaagatgttttaaaaaatgtgtaagaaaattcacataattctgctatttttgtttttgtccaaggagagaatggctagatatgcaagtgatgaaagagaaagagcactaaacttatagatttcaatctctgcaaacactagcttacaaatggtattttgcctcccatgttgactccaaattatttcagctggtattgtacaattttcaaagaccagctaaatataagttgtattaatatttaaataaacattgtttgtttggtacacctttattcttaattccacaaatatatctttagtttcctatgaggtataaggcactttatctcacctacatcattcaatgaaattgataaaaagacttataagaatatgtacaaaataaattcagagcaaaaatacacataaatagaacgaagataaaagactatgtaaaaaatttgaatgcagatatgcagatagaaaaaattatagttattcagattggactataaattagcttttaacttgttgaaaaccaaagtaaaatgaaatcagtaactggattcctattatttaataaagaaatatatatcagtttacatagaatgcttttaatggctatttaaaaataatctagctcaaactgacacagcaaataggagacatattggctcagatcactgggagtccacagccaaggtcagcttcaaaaatatttgatccaactatgcatttggagaagttatcaagaatctacaatctttctctctttcttctataatctgcagtgttgagctttatcctaaagctagtttttctgtggttgtatggtggaaggagccaacagaaagagctacatgctttctccttcatgttagatcagggtttctcagcttgtacattcttgattcttatttgggctgaataattagtttttctttgaaggatgtattttgcattgtaggatgcttagctgcatcatcttggccttgactcactagatgtaagtagcatcccccaaatgtgacaatcacaaatgtctccagatattgcaaaatagcccaagattgagaaccgctactgtaggagaaaggctctctaggcaaacaaggggagattttcgcagaagcccctggaaaacatctcagttaaaagtgacctaaattgcatgtccatactgaagccaaacattgctaagaatagaaacactttcattaggactaattgaaccaatcaagtccctggcgatagaggaagagtcagtttctcttgaatcatgggcttcatagggaagagtgaattcctgaacaaaatcagggatccattagaaataaataaagggataatggattcagggtaggcaatcaacagcactcacaagacaattcctcaggaaaaaaaaacaaaaacagactgattctgatagtatatgtacacatatatacattgaacatatgtatacatgtatacattcaaaagaaattagttaagtcatcacagaggaaatattgagaaatgtggtcatttatttaaatccgcattgagtatatcccatattccaggccactaggtgatagagtcatggtgatgagcaagatgaatacatcccctgccttcattgaaccagtgaaatatacacttgaaagagatcattacaaaaaatatgatgagtgttgtgttgctgggtgccatggaattattacctcactttgcctaagagtcaaggaagggctctttggtatttgcctgcctggttcactctctatttctagcagatggaaatgtggatggctcatagtaggcttccatgaatatttgttgaatgaataaacaaatggatactaaaatattaagttcctatgatgtgccagggagtgcttcaggttaaagagaaagcagtgaacaaacaggtgggaaaagacaggtaaaaatcaactaaaaagatgtggccaatatgtattacaaaactagtctggcttatgatgtaactaagaacataagtatttttctgtcatttttattttatcaaaagggataagtttactcagccctgggtgaaacagtgtcaggcatatgactattcaatttactcttaagtaatttagcctatgatcactttaagttgcaaatatattctcaatcaaaaaattgagtggccaatcccgggtaattatgaacacattaaatttgacttcgtgttaactcttcttcctggtccccttggaacagcttcaggctggaaggcagacctgctccctctgctccccagccttcctgcctcgaatcttctgtagctattttgctcctgactcaggtaaaatggaaaacaataaagccaaaaaatggaggtatgagggaatactgttgggactgtagtgaagtgagtgaggtacttgcctcaggctcaaaatttaaccaaaaaaccctcagtaaccaagataaataagatttagtgaactattacatattaaatattacattaaattaaaataataaatattaaaatatttggtattatttaaattaatatgcattaatttaatgaattactatttattaaaatatttaatgttgaaatattaaattaatattataaaatttatatggaaatattaattttaaaatattttaatgaaatatttttaaaacaaaaataattttttaaaattcatgatggaaaaatatcaacatgttaaataaagacaagatcagtgaccatgacttggtgagccacattagagcgggaaagaaaataatttgtaatatgatggcagggcagttagtcttgcagaaggaggatggaatttagagatatgttgtaggtaagatggtaagaatgagtggttggctagatgtggtgaatgctcaccagttattgggaaaggaaacataggaagaaaagtgggtttggtggtggtgaaataaattcaggaaaaatgaaggtcaagttgagattgcagtacctgaaaatcttcatctgttcatgattgcagagggcccttgatccatgggtatagggtttatgataccttgaacagcattaatcgttctgctaggaaccctaaatatacactgaagggagaatgctcaaggatagcagttctttgggatcaggatgggaaggagtaagtgggcccccaaacaagggaatccaagtgcacagcttctggcagtccacattgatccagagatttaaaagtaggctagctacaatgcattattatgtattgtatatttcaaaatagtcaaaagaagattttaaatgttctcaatacaaaggaataatgattatttgaggtgatgcctatgttaattcatctgctttggtcattccatgatgtacacatgtacagaaacatcacattataccctataaatatatacacttattatttttcagtttaaaagaaaagaatttagtgacattaccttacctgtctgtaaaagggattggaaaatgtaattttttgtgttctattttcttcttacaaggtagccatcagcccaggtaagaaaaaaatgagggtgataattcagagaaagcaagtatggggataggaaaccagtaacctcatccaaaccaggcaacttgttaagattgtctgaactaacatcaacctttgagacctagtatagcacttcccacttccaagtgcccatctgagtacttctaaatgaagtataatacctctacaaaatgaatgtaaatctttaaattatttggacatctcatttgtctgctaaagggagaggaatctatgaatagccactggttataagaagaggtttgaagaaagggaaaagtatgacatcactttccacagagctgccactctttgaattttgtcaaactggttacaatattagtattaaaaaatggctttgaacacacaaaacagataattacagaatgcaggcctaaaatacacttcttgctggaattttaattctgagtggttgctgaactaggtaggtggttgtcaaatttagtttactctgctctgatcaaggaatgtgggttgcatcattcaaaaccaacacgatttaaagatatcttgtaaaaaggagtagtgctaaaattagttgcttgtcagtgattctggtcaccatgattatatggtaaagtatttgtgaacatggcatacagaaggggttatgtctaagtggaaggattttctcatagagcaaaactgttgagcaagacttgattttgaatgatctggaatgaaagaacccaataactttgaccattatctaggcttgtattttgagtcaactaagattcttttagtgacattctaccctaagtggaaaccattgataactttataaaatgaacctgaaacctttcaaagaccatactcaagtttcccatcatagagctctgtatgtcaaaccaagtgtgtgagtttattaaggtattcccccattgccagaaaaggtttactttacccattaaaacctcactcaaatagatatcaagtatctcttatatcctgttacatgatgtaatttaagtctgaaaatacccatgctttgctttaaccagaaatttaaaatctttctcaatggaagcaatagagtatatcactgataaggtaaaggtgatccagtaaaaggtcacaacttagccccttctggacaaacaataaaaagaaatttgtctgctcgcatgttatgtggcatcaataatccagcctattttagcacatcaaatcccttctatgctttgaagccaacctttccctatatccagtatatactaggtagtcatggagggctcccccttgcaaagtaattataacggagctataaaagtaagaccagaagtaaagtgaagaaagggcagacagatggttcgttgccatattgtccattataggggagtggagaagtttacttaatttataatcatgggataatctgaagggaaaaaaaaaccccacaaactctcttttctctgctgtcaaactacagcaatcaacatagaaaacattttcccccatataccaagcaatcaatcaatcaattctgcaggggaaatcagctgggtgtcttctagttcaaacctgacactgtccacctggagacaccatcaagtgctcagtcccacaaaactgcccccttccactgcagacaccaatcgcaagttagggcctctggaacttctcaccaactggcttcaagttggagttcccatgattccctctgtaggttcaattaatttgctagagcagctcataaaattcagggaaccatctacttatattttctggtttatcataaaggacattttaaagaacacaaataagcagccagatgcagcgatacatagaatgaggtctggaagggtcccaagtgcaggagcctttcctctggggtgttgggatgccccactgtccaggcacatatataagttcttgttcaccttcctgtaggcttccctgagttcagctgtccagaagttctccgtaccctgtcctctttggccttttatggaaacctcattggacaggcaggattgaagcatggacaaccatgtagaagtgtgattggacaaaaagggtataatctaatactaatagactgagaggggaacccagcaagacctatctgttgaagttcttcttggcctctctatgcagcattccttcctccagagcatggggcagaacaccttctgaaataggggtcttatgacctacagacaaggtgggtcagataatctttttttttttttttttgagacagactctcactctgtcctggagtgcagtggtgtggtcttggctcactgccacctctgcctccctggttcaagcaattctcccgcctcaggttccccagtagctaggactataggtatgcgccaccatcttggctaatttttgtatttttagtagcgacagggtttcaccatgttggccaggatggcctcaaattcctgacctcgtgatccgcccacctcaacctcccaaagtgtgaggattacaggtatgagccaccgtgcctggagagaatttctgtatggccagctcaaagacagagaagattagagtatatttttagtgtctatggccttcaggagaaataaaaagggacatgggagttataagccagaaaccatggataaaaacctatatgtatgtgacatatatatcatatcataatatcataggttgccattatagattcttgctaagagggaggagtcattgtacccttgagagaatgatctgatatcatgatgtcaggtagaatggatgggaaggccagttaggggctattgccattgttatcacatgctacagccccaggaacatcctaactattatctggaactctgagacaagtgagaaaagggcaacattagcatttgccaaattccttctctttggaaggatgacttccaaactttcattctaacttaagtcttcttcaatcaaaaacctctgcagagccattttttttcatcccccgttattttcattcctgggaataatttagcatctgtctacatttaaatgttacctttcccccaaatagattatgaccaccctaggaccagttaaatggggcttatctcattggagagagctacaaattcatctgtgggaatgaattctggccaggaaatatctgaagggcatattactttctctcttcaacaaaaagcaagaagttaggagatgggacagaaatcttctgtggctgtgaattttagtcagtttgtttcaatcctgagatacttaaacgtaaggcatttgcaacattgaacaacattgacatcttaaaatcatgtaagtctacagtgtgaaatgagggcctcgggggacagggtttccctcatagtcttgtaaaaattacaaatacacctagtaaggtaaatagaattgttctgtctctgcaaattggcatttagatgtttatcttctggtaacatgttgtgacctcagatcatgcactagaaattaaaatttcacagcctcttcaagagactaaagcatcatgacacactttttcctttttacatgagatatatataaaccagatatttgtttctaacgtagagaaagtttagactttttttatgccagagaagacaacatatgcagtgaaaattattgtattaaattgggtggaaaacagtaatttactttatcttctctagataaacccccgtcaccattttaccattttccatgacaactgtatttagctgagtacgatataagctttgcaagccaaaagcattacagctgcctttctttggacaccatcaacaaaatctgttgaaaaaagttgagaaaaaaatgggcacatgagtgtctgtgttctctcgtttgtgatgataccaagttgcttagtattccgtgacattcaactgaattttgtatcggctgggaataaaacaaccgatatgatgagacatgcagctaattgggattggcaatttccatgcttctttagatatttgtagaaaattgtaaagatgaagtgcaatatttgctgatatatgtcaaaactatctggaaaatccagtaatgaacaatgggagataaaaaagaataatggcttttgaagatatatgtaagtagcagtttatttgtaaatgacaaaggagtaaaagggtgataaaaatctggctcatgaaaaataaaaactttggatccaacatagaagcttccattttgctcatataatggaatcccagttggggccagccatggtgggctccagctcttccttcaacttcccagaactaatagagatttgtttctattcaaagttgcaaaactgtctaggataagtactctctcaaaatcaggggaaaaaatcccagcctctggaattatttgatgtatttagttatttgtgcaaaacgcaaatacatatcttttacttctcttctgatacagaaagttaaaccagtatcctaaagccaagaacaaactgatatgtgtacatgtatcaatagtatattttctaggtctaaaatcggtcatgatcccccttcagcctgtcatgcacacagatgaagaaagacagtggggaggattcagagacagggagatgatggggttcaggactcagtgaaactcctattttgatagggttcaaaacacagcttctagccatttgaggaaacagcagaagcaagaaggtttctctgaccttctcttgcccttctcccctgaagcaggctttaaaagaattctctctgaccctttctctgaagtaggtcataaaactttcattccagaggtgcccattctgtacccagagggaaggaaaggaacatccttatcctcaaagctataaatgccaggatgaatctgcataaacaggttttgctaggtccccccagtttgttaccattagatcatacccttttgtcctccaatcacatttttccatgactttccactcttcatcaacctaagcataaaaatatgtgcttacttgtttctttgggtcttcatttctgaaagtccccatgtcacttattaaataaagcttattaagtaaatttgtatgcttttctccgttaatctgtctttgtcagttttattttcagatccagccagggaccccgggagagttgaggaaaattttcctcccctacagagacaaggagagagagacagggagttaacatgcaaatcgacccaacaggacaaacttcaacccagccaaagctttgggttatctcaaagcttgtcttgtgagttaaaatgatcagatatctaggtttgactaatttcgtagggttttaatgcttttaaattgctattataaatagatctcatattgcactgctatttgatgtcaaccactacgctaaatgctttacattcgtgacttaatttaatctccgcaaacatctcattagttaatatgtgcccattttacagataaagaggaatcttaggtttagagaggattagggcagaagccaggatttcaactagggtttctttgactcagataccatgaagcttttacagaagcttttaggatttctataattgattttgttcattgataattgcctatgactcctacaaatttaattaataagcaattactttttatctgacttgcaacctgaaaactatttgtatctattattatttataggtgcaaaatgaaggacttccagtgctactgccagtattggaaataatgcctctgataaacagctaaaggagtgaacctgtgcttcaagcctcccccagttcaatgtaaaaagtgtttctaatccttggccaaggtagtcgtgtaccatacgtgacaaagcctatcagttcttaggaaaaaaacaacaaaaaaattgctgtttgctttattcctgaaagaaatcagtagaatttaatactatgattgtgtgtatcgaaggcaaacattataggttaattgttagttgtctctcctctatttactttacttttccatcataaatttgatagaacaagtcgttaaagttgtacatcttcccaatcagacggagaagaacagcctcaggtctcatatcctctcatatatataatactctccttatcaaccctggagaaaatgagaattggccaaaacttttgttatcaatctgttatttaggtcagcattcatatatggtccatggaggatgaatcacaagatattgagtttagaagtgtcctctaatttcataaaacacataagaactttgtaagattaaaaataatagtttgtatcatcctgtttttttagctctaaaagtatgcctgtctatataaaaacatatagatatatatgaattccctaccctgctaatcatcaaaagaaatgatttcatatgaaaattatatttattcactaatactcctgctaacatttatatttgttaattaatacataaattgaaatttatgcaaaaattattctccactggtttaattctttattctaccagaataattcttctatttggaatttaaaaacatatatccataaattctggcatttctatctcatcagtttttgtagaaatgtatgacaatattttattttatattggtagagtgaaaacgattttacatattactaacattttctattttgcacggaaaactttaaaaattcatcaaaaggtaaaatgtataaccttcatttttccaatagctgttagcatttctcattgtgagtgaaaaattgtcttgtcttttctcatcaaattgcaatggaagtagtattagtcacagtttgcatggaaatctgccagtaaaagaaagtcaaaaacatttctcttcaagcctaataaaaatgtccagtggccttttgtgaagctataaagtatgactcaagataccagccaaaacaaggaaagaaagaaaaagacagtaaagtctcactttttctgtaccacttacaagtatcccaaagctatgttttataagagaaattcgacttcggtgtctctatctatcctcccctgagctaggaaaggaaaagaaaaccttccccatcacaagtatacaaaagaggagtcttgctggtaaggttagcatctgtcaatatcaggtccggtgtgaaagcaaagccgctctttgaattgtttgcttaataagatctccagtgaatggagtttatctgcagcttggggtttcacagggaacacaatgcttcgtgtgcattattttagataggaaggaagttagtttcagtaaagcaagagagaagtgataggcttatcattttattataatttgagtttttgcatagaaaacagtgagttttctaacattgtccataagcatgataattcatgtatttcgtcgcagccatctgatttttctctgggacattattatttgtaatgacttctattcattgtttgtgttccatttgtgaaccactgctatagaattttaatgagtttcatgttaaacaccttttagaacacattctttcagtcattctatagagagtaagaaagcccatccatacctctaaaatttactaaaatctactacaaatgagaatacttcattccaattttaagggtaatttcgagaaacataaaatcgttaccttagtctactgaaaactccatattcagttccaaattctcagcttcctacactaattacaggaactgctacaatgtattatgcagttacatggcaagcaatctgattccccatttaaacttgtcggcaacctgggaaagaggtatcacggttctgatgagaaaaccagggatcagagagtctgagcatgtgcccagtgacatgcagttataattccaatctgaacctctctgtccataaacctcaagttctctcatgccacattgcagttgtcccatagtgttcacagaataactttcacaaaaacaccttttacaaaagaataaatacatttctgggacccatgatacttaccatggctaaattcagagcacaactgatactaatcttgtttccttggtcaggctttggaaatcttggttcgtggctccagagtgtcttccagttgcatctcatcaaagtttttaacataatcgcccacatttgtaaatttgcttttagtctcaaacattcagacacctctaattatcacaccaacaacacaaaaaggcctgaactaattttacatctagagtttccttagcattcagtctcatttaaactttttacttaacccaaacaaatcggtccattaactgcccaaattagtgtttagatgttacctaaaaataataataataatggttttactcaaatatacatattggaagaaaactgaatttgtgcaagcaggtctaaatgatacgtgaaaaactctatagtaaacattttcgcagagaaatttgcagttacctggtgatttcaggttgtatataaagaagaattgagcaatgtacttcttgtatgatctcccatttcacaaaagggattaatattatttttaccaatggcttaatgaagattaaagtgctgatgtgctggagtccgctcatacctttaagagctgtatgtgcacatctcttcacaactctgcattcactaaaatcaagctggtaacctgaatttggccatggtaggagtatttacaccatgaaaactgacagactataaatcaagcctactttctcttcccccctacttagatccagttattaaacatttactagcacaatactgactaaatgagataaagcgtcaataatgaatactgaagtgtgcccgcatggttgcaccaggtgcagggagtgctgactgctgaggacttatagctgtaccttctctgcagattgcccttagctaaggggagttgacttgctcaggattatgccccttccacatcagacagctggatggatgtggagatacaaagacctgggcccccgaaaggccattccagctccgcagcgtcttgtgggattagctaagtggtctgttggaactgcatcatagtttaacatttccctttgcctagtcctgctttcctccctctgagaacaccccccgactcctcctcactccctgccactaaaactgtctgcacaaatctctctctgtctcagagtctgtttcccagggaatttgacctaagacatacatgtaacattacctagcacacagtactcgaaaagggtgtgagtttctaataacatatctgtaatcattctttcactgtaccttagttctaatctagttgttagttgttagagttagaggaaatgatttcaggtaccttttccttttcctttctttttttttttttttttttttttttttttctgagacagagtcttgctctgtcacccaggctggagtgcagtggcacaatgttggctcactgaaatctttgcctcctgggttcaagcaattctcctgcctcagcctcccgagtagctaggattacaggtgtgcaccaccacatcgggctaatttttgtatttttagtagagacagggtttcaccatgttggctagactggtctcaaactcctggcctcaagtgatccgcccacctcagcttctcaaagtgctggaattacaggagtgagccactgtgcctgaccccttttcctcttattaagttaaaaaaaaaaattctgcattggacaacacaaccaaataatggctatgtacaatcttagttggcttcaaaatgctaaatctgaatcaagtcattttggaggccaagcagacaattggaaattcaaatccatttaagagtcagaaaaaaataaaatggttaaacttgactctggtgataaaataatttcaggagttcatcaaattttggttggtgatcttcaaacacatctaattttgaactaagaagacactgtactcagggatcctcaactgtaacacgaatgcaaaattgataactccactgttccgagaagggtaactaacaggatgtttctttagtaatcagattagctgatataaaccttctttggtcaatttcaaagaaaaaaaaattgaatgtgatggccatgttattcccctcctgagaccacacaggacctaagcataacacatccattgggaggattcaatgcaaaccacaactggaaaacattgggcagccattcacagccacccagtaaaataatattctatgtacattcttggttatgcatgaatgttatgatgactgctacgggattaattattttatttggaatcataatatttctcagaatcctatgaggaattttacaaaattaagccataataattcatatatttgttatacattaaaacacaatatctcaaacagattagaaaaactattctttttttaaaaaaatatttttcaagacagagtttctctcttgtcgcccaggctggagtgcagtggcatcatctcgactcactgcaaccttcgcctcccgggttcaagtgattctcctgcctcagcctcctgggtagctgagactacaggcacgtgtcaccacgcccagctaatttttgtatttttagtagagacagggtttcaccatcttggccaggctggtctcaaactactgaccttgtgatccacccacctcagcctcccaaagtgctgggattacaggcatgagccgctgcacccagccagaaagactattcttaaagcattcctttctatgcattggaaaaatcacattgaaggaatattgtttggtatctgatttctagtatggaattcaggctcagcaatatggtgaccatacgctactatgggaggttactatcttgatttttttctgtttattcgctgacttattacttaatacagacaaccctgggcaagacagtagagaaggcactaaggataatgagagaaatttagaaaggttattcctttaataaaacccatagctttatggaagagccccacatgtatgaaaacaaattcaattcaaaatagaggtaatttagtggctatcttcccggcatgcttatcttgcttttctagataacatcacactgctcctctacatcctttatccccattatcctttccatgttactctgttggctcccagtcatagaaactaaatcccttgacacatcagtctcaaggtgtgcttgtgagaggccgatcctggggttatcccaaccgaagtttcttctcttttggatctggaaagatgtgaagcagaggctgaagacagttactttcccacaacttgcataagaaagccaaagcaaaagaaaatatgaaatggtttccaagctcttgtccaaccccaagagctggtttccatcactgatcccagaagcaatcttggtatccttttcaacaagcttgagttgagtttctccagctctcaacagaaagtgctcaccaaagcaagcatcgggaacagctccaggttttgtggggccccaggcttataccatttggtaatcctcttggaaaatgaaaacaaaattacaaatgcaccaccaggtataaaagtgcttatttattttgaaggaaaaggaaaaataaaagttactggacttctggggactcatgtctctggtgctttacaaacatgcttacacagaattgcttcccagttgcaaactggcttcccctcccacagagaattctacaacaaccagcaactccttggacacaaaggggcctgtgcgcgtgagggatcctgaaggtcaggcttcactcactgccagataaatctgcctccagcagcacagatgtctaaagtacagtgggagaataaagagagaaagggcaaccccagtaccaggaaaggtttctcagaggggtgagcactctctggatgattaatcagcattctaaaacagaaagtgggcgggtgatccaaggttgagtgaattatttgcactaagttacagtgtcaagaaataatcgcatgtttgaggaaagtttatctatttaaacatgaagacacatgagaaaaaaagatgattgcagagtggcaaattgaagaacctctctccatataatcctagaatatgctggttaattttgtgtttttccttcccccctctactcttcttcctccttgtattcactttcctggactttgatcttctaggagggaggatacttcaaagccctgcttccagaatttgtatgtagagcatacgccttctattcttgggatagaagattctccaccaaatcccactattttgtccttttccttaaaataaacatagcactcaaaaagggaagaggataatggagcacaacaataacaaatgatgttttacagcaagatccttaagacactaagaagcttgagaggaataacaaacactactctttttcaatataggacctatgtcaccaaaagttcaccagtgtggtgctggatggagttgtgtggaaaaccagaggattttttttaactagagggaaatgaccctccatatatttaaatatatgtgtatgtattaaaaagttagcatcaaagcaaattgattcaacttttcacagaatttacacaagaattctaacatagaaaaagaatatgggtccacactctgttccccatgcactcccttttcctgattctgattttaaaacatcacttagcctgggatatagtgggcttggtgagtcctgttaactgtactcaggaccagcttgcattagttaataatactcttaaagctaaagacatatttgtgtgtgttctggaggaatgggggttaggggctgcctaggggccagggctgaattttgtttcaacgttcctgcactgtctcattgctaagtgtcactaccctatcagacatcctgccctgtcaagctgtaatgccaactcaagacatgcatcagagccagctcttgtctgttttgtgaagcagatgctgtttcctgaacctcatctgtcctgccctgtaccagctatctgttgaggtccctcttcctccctgtacttgcagacgctctcctgaagatgctcttgtctcttcaggacagagtgagacacacatgggcttgtctttcaggtcaatgtccagtgttgtttacttttcttgctccccttgtccataacatttctgtttgattctcccctccctttgtccaagtaagatcttccacaataattataatcatgaagggaaggtctctttcttcctcctctaggtttgaagctctgtatgaatggtggattgttttagactgtctctcagtatagtccccaggtaagacctgggtaagaccaagttcctgtgcatattgatcttcaaatttgatcttctctcaataggaggaggaggagaaacgggagttattatttctagtgtcatttctggggaagacacagctcctaaaacagaatgctgaaattgggaagacagtccttagactaagcaaggcattacaggactttgggaaggctaggctccctgaaggcgtccacctggtgagtagatcaaggcaaagggatccctgcgttacaaattgaagaagccatattttgaaaggcagcttatccagtaggaaaattttcaggaacaaggcagcactgtaatttccatatggcctttcatgtgacctttctccacttattaccaaccacaaagcaactggaattgatgtttaaggagaaagaatgtttcttcgcaagctacaaataatgaaatgtggtatatagctttccttcccagatgacattcaccttttatgtttccatctattacccacatctcagtatacatgaattcagttcgtgtgggtataatgtctcccatgtgtctagctcatgctgggcaacttgagagattacaaaagagctacaagctccagagtctaccctatgggagacaagactgacccccatgagactttttaatgcaacaatagactttgcaaagtgcaatatcctatcctaaaagacccatccaaacagaaacaaacagaatgatgctattttcaagtgtgtctgagaaaatgtaggttttcctaagggtctgtcttcagctccttcatttggtcatcccacacactgttttttgatgatctcttgctttctaatttaggtttttcttggtcttattattgtagtagtgctggtagttttttcattttgtgtgtgtgtgtgtgtgtgtgtgtgttttcgagtgctataactaaacaagaacaatcacagatacctgccagtgcttttttaagcaaggacacgttgatagccacagcatcagtagctaattcacctttatgggaatcccatttgttattttgacctcttggctcattctctaaccaaattggcaaaattcccaatccacccaaaggtattataaaaagcattcatcctattattgtcttctcttaaaccctcaggtaaaatgaaagaaaagtgattcattcaatattgcctttcatccattttgaaaatttgagtttatttccaaatacactaggaacaattcttttggacaagagggttatgctattctaaatcatatgcatcgggccatgttacatggtctgagagtgatttaaaagcaaaaacaaacaaacaagcgacaatcaatagttatatttaagacgcttaagggaatggataaccaagttatttaaggataactaagtaccaattgctcaaattaataggtgcttatatgtcacaatgtcaagctgtgacatgattctttgcctcttacagggccttgagagaaataggggttgagtcatttaaagcatgaaggaacacagtgaggcactcataagatgagaccggttactgcaggcgagtgaaacccggacttcccggggaggctctccaatcaccatctcaccacttaacagttcagttaacaaatttggacaaaaagcaactgaaaacttcatccttaatgatcaaacccccttgaagccgaagtttccaaaggctttactaaaagaatgggtgtcactaatcaataatgacactgagcgggacactcccaaggagcttgctttctgagagatgtttgttaacccagcaggaagagtctgcagtgaaatgcttcttacttcagggttaattatttgtcttttttctccagagccaataggagctcaaagaaagaataaaagcctattgctgagctccaggaggaaaaaaaaaaaaaaaaaaaaagtcgactctgctgggttcccagcaactagttagtttttggattgcttttgtcttggtgagagagaaattcctggagtgtggtcaaaggatcgtcactgtttttaatagagtcaaggagttttctgtagactaatattatttttgaaatgcaggcttccacaaatcttttgttttaggacactctgacagaatgatggtttattgtgattaacataaaagtaaaagcaataaaaaggtaacaaaaagaatcacatagttgggtcaataaatgggtaacatttcatttctgagagaaaaaaatccatttgtcatgtgggtgatttttcatttttaaagtcacaggttaagtaataacatacatatgaatcaactttttggttagaatcttacttctgaaacgtactgaaagaatgtgtgctttttttgtttgtgtgtgtgttttttattagaatttttaactaattagtatacagaaaaaaagtccttgaaagcattttaactcctaaggtaatgtttaatgttcttggaatttcacaagaattctgaatataattctaaatgaaaatggagtttactattaatgaaaaattagtttgggacaaatggtctttactgatgttttaaatatgagagaatgtttgcgtggttctttctgtaccatcctcgggctaagtactcacaatgcagcctgcagcaccttgtcacattttactatcacttttggttcacatggctgactcccaactatactttgagctccttgagggcagagttcatacctattcactctttctcacctacaatttaaacaaatatttttctagattgcatccgtgtggtaggctaaataatgtcccccttctaaaccttggaacttgtgactatgttaccttacatggtaaaaggaaattgcaaatgagattaaatcatccaggtaagcccaatggaatcataaagtcctttataagagaaaagcaggagtagtaaaagatgtgatggtggaagcaagaggttatactgatgcagggaagtagtggtcagcgggtcagggtttataggtgacctctagaagccgaaaaagacaaagaaatctattctccctttagggcctccaaaaggaaccaactttgcctacaccttggttgactacatttgagacaatgtgttacagcagcaatatgaaacagcaatacagtctgttattatttggtgcactaagattaactattctccttgagttctctgatgaacctcttggtatcacatattcttagaaaaggcagcaattatttgaaaggtgaaaattcttgagtttctaagttaaacttcctggattcaaagctcagctctgtactaattgctatctgaacttggtgtcatttaacctctcaaaacctcactctccccttggtaaaatggagataacaatagttcttatagaacaggctattttgcctctgataattaaataaggtagtgcatgtgtgtgtgagagagagacagtgtgtgtgtgtttagcacattacattgtatatagtatattggtcagtgattttggtttataattagaaaatgtaagcataaaaaaaattgactgtgtctaataaatcaccttgcaaaaacacagattttggttggaagtcacttgtcgtgttgcccattacaaatgacacacacctaggttgtcacagagcagaggaggaattttctaagtgttcacttttccaataggtttagtaactgaggacagatccagaacacaacacacttaagctaaagtgacttcatctttactctggctctcttagactgcctgagttctcttcacattacatgtcctgccaggtcccggagccttgcacaggccacatgccctcttccaggaatgtcttcatcttactatcaacctctttcttccttagcaagatctgcaatctctgtgacgtctttcctgccttctcaagctcctagttttgaattccagttctcccaacatactgtcataagaatctccttaatgcttgtatctaccttcctaccagattttcagggaaactactctgtcttttttttttttatcatcaaagtatcatgctaggcactgaggaaacagttcaagaaattcaaagactagattgcttcataaaccaagtctttgcagatgacccagtggtttaagttacattaagcatatatccctccagaaatacatacaaataccttataacaaacttacatcttaaaatgaatattaccagcctcaatattttaatccattagagtatttgtatttgatacatatttcagcaaactctggcaactcaattgagcatagatgttggcataagaaaaaattattggtacctctctaataacacaattaataccatcataaaattaaacttttttactgtgtgacaaaagaattgatatttgagggattaaaataaaaatttacaagatcatgcaattataaaaaaaaaaaactgaaccgtaaaatcttttaaaaagagaatacttcactttcccccaaagacattatagactaaaatataaatattccttatcccaaataaattattttgggattattccttttctataacgatgttataagagtcaggtaagacaataggatttactttccagagaattttctgagatatagctttcttaggaaataaaaagatatctgcttttaattcctcagtgaggctgggcacggtggctcacgcctgtaatcccagcactttgggaggccaaggcaggcagatcacgaggtcaggagatcgagaccatcctggctaacgtagtgaaaccctgtctctgctaaaaatacaaaaaattagccacgcatggtggcgggtgactgtagtcccagctactcgggaggctgaggcaggagaatggcgtgaacccgggaggcagagcttgcagtgagccgagatcgagccactgcactccagcctgggcaacagagcgagactccatctcaaaaaaaaaaaaaaaaagtcctcaatgaacaggtgtttaactcacctttcagatttcaaataaatgcttaatgtattagatatctgataagtactgttaataacaaggatttatttcaaaggatatgtatattatactctggttcattcaaataaatattcaaggtcatcttgacaatgtcagagaattgtcctgtctcactatctgagttctttgcagaatcttctggtttaatcgttctttttatttggacatttatttctgtaggcattcattccagtttgcaatttataatttgttcttacaaagagagtttttataaaagcaatgatgtcttgacttaaaaaaaacctcaaattaataaacattcatatttcacattcatgtgaaataattctctttttcccctcttttttttgtaaaagactttttaagcatttaactttcttaaatagtagttgagatcattgcccatttggtgtgggtataggggaaattgggctggttgtttttttcattttgtgctaatgagtcccaaaatatagaattgatacctgggggtagagaagaccagctagaagttaacttcagacctttggtgtcagattattctttttcattactgctaccaagtagcagatacatatcagggaaggaatattctattgcaagtgattggataggtaagtgtttttcccctaggaaaccatggttgccttatgaaatagttctgtggctttcaagatcctgtgcagagaaaggacatgtccagacatactattcaatcaggttattaataaagagacattgagtaaagtattaaaagcaaaaagattgtccctgacatgaaagatggacaagcaaataatacaaataaagacactgggcagcattttcctcatctagaaaattactggattgaaatatcatctttcaatttatttcagctattatggtccataattttaaaaggatgaaacaggatattagcatctatcataagccaggcttctaggaccaatccttcaaacatttcattctgttcatgctttttcttgtctctaactgaaggtttaaaagtttcaatagatatctgtgtaaaaaagatacatacacacacaaagagagggtagatgagcatgaactggagaactggaagtgtacatctcatccagatgtctgtgccattacaagtgcaacaattttcaaaggcaggatgttatagattccctcacccacacacaaatttataaattcatcaagctcctactattccaaatactgtgaaaggtgataggaacatataattcactatatcatagtccttatctttcctttcctatactaagtttgagtttcaaaatatcatactcagtgagtcaaaactgaaaaagaggcaaatttgattgaggaaaggggtgactattggagaagtatttgagctgttatcaatagaagcattgaactgtggtccaaataagattttaatatctaagtagagagaaaaggtaataacattcccacagggagggaacagttttagtaatgatacagatgtgtgatatgcttggcaagtcttgagaacagtgggaagtgtagcatgtgtaataggccgggcgggaaagtgggagtggcaggaatgaaacaggaaaaggagtctggactcaatgcatgctagggattttggacatcattgcgtggacaacttgaaatcatggaaggtttttaagtgggggatttgaaatacttcgcttggggttgggaggcagaactgtcggggataatgccagagtgatggggtcaacgaaatcgtgtattgacctattcagaaagtccaggggaataagctcaaggacctgaattcagtagaggagatgaacgattaaagagactttgccctaagaaaggcagtctcagctaagacaaactttaaaaaaaaagaaaaaaatactaaacttcaatagcaaattaactaagttaaagtatataggctggcctagctctaaccctgattacatggcaatgatttgtaattagtggattaaaggaaaagactgtctcatggcttctatttttgatatactgataatgtttgcttgtaaatgtatacccaataagtttagaaaataattatttgaaatggtttttccctgaaagtggtaaatgtccccactgaatcatgtttaaactcttagctgttgagcaaatccatttagaaatagttaatgactatttaaactgcagtcaaattcattcaaaaatcacttttatttagtgaagtgtgaatgaaagaggaatacttgtttgccctttagtgattctctaatcactaaattagattttctatgtaatcaccataataatattattttaatatacaccgtttccctcatgatgggggtggatattaaaataatattttcatagtagttggagctgggaaggagaaaggactgtaaatgagcacaagggatcctttagagtgacagaaatgttcagaaatttgattgtggtgcaaactgcacttgtctgtaaattaactaaaagtcatcggactgtacatttaaaatgagtgaattttatggtaggtaaatcataccccccaaaagctgttaaagaacattattagtgtgcatgtgtgaaggactttaaatctgctaaatgagacagtaaatcttgcagtcatttatctaataacagcttatagagacgttactacggacaggtgttttctagacaaatgcttctcaaaatgtaatgtgtacaagaattaacagaggatagtaaatgcagattctaattcagtaggtctggtgctaggcccataattttaccattttaacaaacttccggggagtgtcatgtgttggctgagaaaccacatctaaatgtcaaggttctgggcacagggatctggcaagggaacaagaaggtaattttcttactcctacagagctgacatgctaagaagggaggcaggtagtaaggaagtaaacaaataaaagctcaagattgtttctcatatttactacacagccttcagaagagccctatgattcagcattctttcaaaaccttttattcattgcccaccatgtgccggggatgacgataggcactggagatacaattgtaagcatactgtaatttctgatgttatagaatttacaatctagtgccagacccattgcaccttcaaaataaccctatgaggtatataatacaatacaattttactgattgattgattggttgattagacagggtcccattgtgccacccaggctagagtgcagtggcctaatcacagcttactgcagtctcaacctcctgggcccaagccatcctctcacctcagcctcccgagaagctgggaccacaggagtgcactaccatgcttgtctaattttaaaacttttttttgtagagatggggtctctctatgttgcccaggctggtctccaactcctgagcactagcaatccccctgccttggcctcccaaagtgctggggttagaggcatgagccacagtgcctggccaatactctcatttttagaagcagagcatgtgaatcagaaaaggtaagtcctttcttcaaggccacacagtattcacactgggcctcaatcctaagacttcatgtcaacactatgctagactatacactcttcaatttcattgctacaggaagaaatgggaaatttacattgcattcatcctccagaatattatgttcttttgggctttggtgcccttggcaaactgtactgtctatttgttagcttagttctttcctctttctgggtctcacgttattcaagccctcttgtgcttatatggaacgttgtaatttagatctgcatttctttctcttctttgctaccaatttcagcaaccttctgcggatctatttatactctctcctcctgggaatttgaagttcatcttcatttatcgtctgcagatgtacttctcatgctacttacttcctcttttcagctcactaatgatgttgttaaacaaaatagaacccaacactgacccgtgaggacagcccctcagattctgtgctcattttatgtcaatcatccatttcttcaatggaatgtcttagcttaaagtgctcgtactgggacaagaacaaaccactgaagtttacataagaatataaattcctggatacatatgggagaaatatttgaaaatcaacaacttatttgtataactatgaaaaattacaagaaatataaaatggaaaattatatgctagtatatttaaacagttgagataacatttattgaacacaaacatgtcagctacttaattttattattagtatctctaattattaaagtcatctaccaatatagttacatttcacaccaggaactgctggttgggtcagaaactgagggacagtgaggtgaggttacatttccaggactttctccgaagtgcatatatttttctaatattacatattgcttaaataaatacatatttttggttgtcattttaactggcctgttaagaaactgtgctacttttctaatttgagatatgaaacttctcatactctcccaaagagtacctgatttgaagaatgtgaaaaagtgttcgtttctccttgactctacaagaatcagtaattttctgacaaaaatccgtaggtctagcctgttatagagaaaggtatcactaactaccttgaaattaagttttgtgaaacaatttccaggttttataaagctggaggagaaaagagaaggaagacaaagagagctgaagtatgtaaatggcctatagtatttgaatagctatggtttcaaggcaattatattaagtacacaaacctgattttaatggccatgcttagaagatgggcagagtgctaaatgtgtaagtcattatgaacttggcacagtagctctgtttattttaacctttcttttgctgcttttgttgaggatgtttacttaaccaggctctattaaacatgctaaaaacattattgcagactttgtctttgtgagcactttcagttgacaagccacagaagtgacaactcatcaggaatcatagatgacagcagataagctagagtggcatgaagaggacagacagatatcttttcatcttggactaaaaaaataagaaaaagaaaaagaaaaaaaaaactttagtgaaattcagtgtttctaaaatgcaaaggactggttgtattggagactgaattattgtatttacctgaacagcagaacctgtgtagggcactctggaggatgctgccctccagtgcgctgtgaccctgctggacctgcgtgactagcacactctggcgtggagaaaatctcatgcctcaaagtccatactgaaccttgttattctaagcatccgataggtgccaaacaccttaaccctccacaatgttacccaagtctaggaaggaagaaagctcttttatttgtttcacaatgcagagataaggaaatgagaaactacagaatcatttgttaataatggcccatgtgaaatcccagtttacctttagcattatgattatttcttttccttctttcctttccttctacctcttctttgtccttcttctccttctttgatatcatcatcttcttcttcttcttctttgtcacctccatctttattagtctttggagggggtctttttgtcatttgatataattccagtgatatttcctgataaagactgttcatccatataaaaatacattctaaatacttattgaaaatagtttgaatctttctattttgaagattttaaatatcaggttcttacaaaatatgttcctagtagaaaggtggtaattttattctaaacacggaaactgaagaatttttgttatacactgtaattatttatgaaaacaatcttcaaagacagcaaattggcatcaggggagaaaaccatatgcttatctttactatttatataaatgttaacctgatattttaggctatggttatcaccaaaattatctgatatgttcttttgaagtttgttgacaaaaaccactccagatgcaaattcattttatgtagtgggtggtcttagaagaaaataattgtcttatttattgaaaaatgagcatccaaaaatatttttaccagggtttagagagggcaggattaataaatataataattaacatgagagaatgaatgtatgctacataaaaccatatgttatttgatttacgaacaaaatgtattttttaatgaaatgaatttttgagatctaaaaacaacatattatttttacataaagttgttcatgttcacatatatagagtctcctgtagattgtggaatatggactactgcttatgatagtgtttacaatctaatatactttttatgctagtgaacatcacttgcttatgagaaaaaaagaaagtttagatacatattagtcactcagacttataggaaatcacttagcaaatttctaggttgttatcataccagacttaatctggaaatgccattaatttagaaaccagtaaatacagattccagtgcaggcccatagaactaagaaccagggcttcagagtcagacctgggagtaagttatttaacttcttctaaccttattgtccccatctgtaaaacggagataataactgtattgtacaaagttttctagaaagccaaaatgagaaaattaacatcatgaccttatgtcagtgcctaaatgtactcaaccaattttactttcctttactttaggaagtaggaatgttctccacagggacaagagccatctttgatctatatttatggctgtcagagagcttggtagagtgttttacatgaatcactttttaacgaatatctgtagaaataaggaagaaaggaaaaaaagacctgcttccaatgctaaaccaattcctgttctaatatgagacagaacttacataagtaaatatttatgtttgaaatttgcatgtaaaaataaatactatcctcaaggcacataccagctgctaaattacactcaggaaaggagtttgtattgctgctcaaaaggatttgaataaaagtattctgtggttcttcatagtgtccatgaaaataaggaaacaatacaagcaggcaggctcaccaggaggcccttaaaagagtctatgtgtgctgagcttggctcaggctgagactgttgaaattcagaagtagaggaagaaaaaacactgagtaggaatcagtagactcggtattagtctggacatggtgggtaattggaatggggaggggatgccaggggtatctgcctcggaaaccatggtgcagggaaagcagaatagatgggctaaggagggatcataattcccttttcttccccatgtttagatttaggtgatggcagaacatctaagtaaagatgttccataaacagaaagaaatatgtgactgggtagaatatgaaaggtcagggcaggagaggaagttctggaaattgtctgcatagaggtgggtggtacataaaattgagggctcaagcatcttgacttgctcagagaatgtggcttgcaaaccacagaagatgattaaaaacattcactattttaattacatttttttaaagtttctacattccctctgggggttaatacagcatcaaattttacacacttactcatttagatctaggagaaacttgagaaaattctgatccaatttctttagtttataggcaggtagcagcccaagtgggtgaaatgacatggtcaaggttattgagcaaataggtttccattttttcattcattcagtaaatacaaatatgcagatatacatgagagcaaatgtgggatgattcaaagtcctatgctagcatgcatttttgtttacaaattgtcaattcttttgtgactataatttagattcgcacttgtgctaaattaaaatatgcatactttaaatgattgacttaaagcaatgtataataccataattggaaaaccaaaggtcttctacaagcattaacatgtccttttaaaaacaacaggctgatggtgtttaactatattcacctttagaaatatttcctcactttagcagaagtaagtcagaataaccagtaggtaatatagaatattttctaaacttcaatttgaagatatatgatatttctgttttttaaagttgatcctgccatgtcatatgcttaacttaaaatgtctaatgtggacactctaaactagagaaaagagatactctttccaaatcaccttttatgtacttggataaaaccaaaggaaaggaaataaatctagcagaaaccaaccatggcaatgctttcaggtttcagttgtttatttagaaaatcactcaatcattatcttgatactttaactacacagtttattcaactgacagtagccagaataaagcaaattcattaagctatgagttttggctttgatttgtttctggtaatagtctttcaaatgattacacagcttataattaagtaagtcaaccgacagaaaattgattaccttccaagcaagtgctgtctatctatccttaatcatctttcttggaaagttctctcatataatattgttttcctaaaacttcaacatacatactggtttattttctacccctagggatcatgcaaagcaatcataataactcctttggcctggtaatcttttcaatattcgaagaaagctaccaggttccctctgagttcacttgtaccctagttattcctccttctgaattgcactaagtctcttgctctactggattttctccacagaatttgttgttgttcacttaggactttctataatgtggtaccccattgccaagtagagagaaaatcagctcatcagctcaggagtcggacagatctttatttgaattgctgcttcatcactaacaggttgtttaatcctaaacaatttattcaatctccttgaacctcagttttcttatgtgtaaaattggaaatgagaataataacctccgagtcctttgtgatgactaaatgagattatacgtggttcagggcctggtgtggctcttatctaacccacacccctaatagaagtcaggtctttgcagattaaaaaggggagtcctggccaggcgcatggctcatgcctgtaatcccagcactttgggaggccgaggtgggtagatcacgaggtcaggagttcgagaccagcctgaccaacatagtgaaaccctgtctctactgaaaatacaaaaattaggcaggggtagtggcgcgcatctgtaatcgcggctactcaggaggttgatgcaggagaatcggttgaactcgggaggtggaggttgcagtgagccaagatcacgccatcgcactccagcctcggtgacagagtgacactccgtctcaaaaaaaaagctgggggagtcccatcacctcgtagatccagaggtcatgttttagctggaagtcaaggagaattgaacgtgtatttaaacatttgcatgtttcacatatgctcatgcacgtacctccttaataaagtgatcatgagtatgacatcacaaaatacttctattgaatatctgtggcaatgtaaatgacagaagatgaaaaaggaaaagaatacatttgggcaaagagtagtttagaccaacaaatacaaactagtgtaggtcatgttgcactcacattttcttatgttaccatctaatctagtttcaagttgtacttagcttcctattttaatctatttttattttaaaggttttacaaatgccacatctgccttgtgtagctccttactagataacagatttttcaagaaagaagtgtaagagtaagcaaaccaagtcccttaaaatattgtccaaaagtgtgggttgcttctcttctaaaaagatttccttctataagacaatggaagctattgggttagctttatatttctcataggatgaccctaactccgtatcttctaccttcctaaattatcctattccctcaaatatagtagttttggtttattgctttgaaagtggcaatgactgctttcaaaagacacacatgtgcacacacaaactaaatcttacagtatagaagtattgctaaaactgtcccaaagttttaattttccacaagtcttagtaactcagcctgctaagtatctgcttgtaagaaggtgctatattttttctgcatagagcaaataagaaacatcccttcagctgcacttatatttttggtaacacctgcacagtctcctaatagcagagacaagaattaaatattcttttcctaatgtagaatgcccagcccagtctttctttcaaaatccccaagattcattcttcattaagcatgtcccaattacctttcagtgtaactgataactttgtgtttgtgtgtgtgttccccttttctactttatatacttccatcagaatatctacataacttaaaagatctgcattcttagctgtcttcctttggggccataagatttctgagggcagggaagatatcctagtcaccccacaggtcaggaacaatacctgcctcaacagattttctcctctccagtgaatacctttggtgaattaagacaaaatcatgcagtggaaagattgtgaccggaatttaggaggcccaggttccactcctggttctgtctctcagttatgaatcagtgtctttgagaaagttaattagctaatgttaggagattgagctaagtcatcattaatattttctcgggtcaaaaattctgattcttaggattcaagtattcatgatatacttaataatatagtgggcataataaaagatttttaaaagtagactagtataccggccgggtgcggtggctcacgccggtaatcccagcactttgggaggctgaggcgggcggatcacctgaggccaggagttcaagaccagcctgaccaacatggagaaatcccgtctctactaaaaaaaaaaaaaaaatacaaaattagccaggtgtggtggcgcatggctgtaattccagctattcaggaggctgaggcaggagaatcgcttgaacacaggaggcagaggttgtggtgagctgagatcatgccattgcactccagcctgggcaacaagagcgaaactatgtctcaaaaaaaaaaaaaaaaagtatactagtataccactctaaccaaaaagataaaatgagattggatcattggtattggagaacatgaagttaccatgcagacaaacacaaaatgaattctcgttaatgtcttctctcagattttaagtacagattcatactatttggtatgatttagtatgcttaatggcaatgtcattaaatgtgttcaagaagagtctatgtccttccaaaattgtctaaattgctctcagaaagtattctgttctgggagcatctggctcaattgtccatgggttatatgtggatgtatcattcctgaatcactggcaccagtgcttaatgccaaacaaaacccctaaacctcaaactattaagtgttgagcaagatatttagcaacactgggagttctaaaagtacatcatattttggctcagatacctaggggaaaggacaggtttttaggattaaattgatttctgagcatcattatctctcccacagaggccatacacaatttatgaggaaaaagcaaatcacactctcttcaaggatacatttatatgtcaaggtaatagatcagccttcttctgtttatgtcagttggtcagccaatgaagaatgtggctgaacatgcaaatgagctcagcagtctagaagcacgaggtcctatccctcattctcagtgaaacaaaaccactctgtaaatgcaaatgaagattttgcaatttgaagcaaaattgtataggtttccaataataatgtctagaaaaatctttaaaatttggtaagttaagctggtatgaagtcaaaagacatagagactgacagactctgcttatgtggggtttcctaaatatagttttaacagggactatctacaggttcaggcatcagttttattacttcacaatgatgagagtgaaaaaatcacttaccctgaccaagcatgtaagacaatgatttctagatcagatgatagctattaatttttcatgggagataaattgcacctctctacccattttctgaagggcagggcactccagagaccaaacaacaaaccaaaaacccggggagtgaactataaaggagaaattcagcatggcaaaaggagatttacatcaaattaacatatcttgagatgttattcttcttccctgcaggggtatttctgtctagacacctaggaatggtcattagaatccgcacttcaccctgaagggggctgacaatacatactaatttgcagtctctcactttgcattttctacagctgtggttctctctgcacatgctgcctatagagaatcacatcacatctcctatcatatcagaatcttttctattggaggcaaagagcttcgggaaacattttactgtcttgccactagattataacatatatcggattgattattctgacggatcctgctctcatctcattgcttagtggatattttaaatttaaattttatttccaaaatcattgtatttggatgcaatggggagggagaaaatacaaaagtgagaagaagaaacttacactcttaccattatttttgtcccttggaaatgctcctaggttcctagaattccttcaagagttataatttttagttcaaaaattatatgtggtcagtggtcagctaaaattggatgactttggccaagtatttaggtttcttaaatatatattatggacctcctactttttttttccaaattctattttacattgtaggcaatctgttcacacatcagtgtctgaggagagacatcaatcagaaatccaagaacttccaattaacttttatcgggcatctagccaagagtcctgctgggtcctggaaggagaaatcaaacataatttctgttttcaaaaattcagaatctatcagaaaaatagatacgagtaacactgtgtaatcacacaatgggatgtatgatttaaactagaactgtttaatagaaataaattacaagccacagatgagaaaccacatatatgattttaaagtttctagtatgctacacgtggaaagtagaaaataaataggtggaattaacaatgtttattatttaattaattaattaattaactaatttatgtattttgagatgaagtctagctctgtcacccaggctggagtgcagtggcgctatctcggctcactgaaacctctgcctcccggggtcaagcgattcttctgcctcagcctcctgagtagctgggacaacaggcacgtgccaccatgcccagttaacttttcgtatttttagtagagactgggtttcaccatgttaagcaggctagttttgaactcctgacttcatgatctgcccgccttggcttcccagagtgctgggattacaggcatgagccaccacgcccggccaatagtgtatattatttaacccaatacatccaaaatattaccatttcagaaatataaaagtatttgtcagatttttatatatttttgtagtaagtatttgattaagatgcagattttacatctgcagcacatgttagtttgaactagccatattttaagtggacaatagccccatgtggctagctgctaccatattggacaatacagtaagcagcatatgataagttctgagtgagaaaagccaaggaacagtttaattttcttggggctatcaggaaaattgaacagaatagttgacattggaatttggcctataaagataaagaggattttactagataaagtggtaatagattttggccagattttgaacctctatattacatttgtattttgtgttttaagctatggcttagctatggctaagcagggaggaatagaatcagggtttgctttgaaaacgtaaatgttggcaggatggaaaatgcattggaatatggaaagaatagaacttaatagaccagttatgtggctattgcagagtatgggagatggatttaaatatcttctatatgcttgaggctctcaaattttactcttgaacccacatctctctcctaaattccagactcaacaattgtatacttgacttctcactcaggtgccaaataggcaattctaacataaaataacgaaaactcagcttccaattttccactcaggcctctgtatacacagtcttccccatctcagttgatggccactctccttctagtagagttgcccagattgaagactcctttttctgttcctctctcatagccaacgcctcaagaaatcctgttgactctaccttcaaaacatttgaaatctgaccacttctatttctactgcgaccaccctggtctgagccactatgatccctcactgcattattgtaatgggcttctaccttgtctccttgctcatgcccttttcccctagattatattttcagtacagaaatcagatgtgattgcatgtttgaaattggaatcaggttatctcttgaagccatacaagggctccccattccactcaaaggcaaagtgcctgtggggcagattagattctttccaactcattattccctctatggtacagaattatgcactcatgccttctgccatgtgaatttctagtatttcttaaaaaagcaaacagactatacatccctgccacattaactatgagcatgaacaaatgtatttctttggccagtggaatgggtggaaatgatcttgccttagagtgtttgcacaggctaatccctctgccttagaccactcctcctttagttatctgcattgttcacatcctcattttcttccagttaaatgtcaccttcttggtaagacattctcacagcccacttaaaactgcacaggcaggtcatgacacatatacagttgggaataacagaatttgaaagtaatttagagggccaccagttcagtggctttccaatgaggctcctaggcaatgaaatattctgtagggtttctttgtagagtaagagtgtggagtaatgctacagtgggattcctgacacatacacagacacacatacacacacaatccacaaaagcagatccagtgactacctgtgtctgagtaagtttacgcaaaggatttgagcaagggattttgaaggttaacacaattctgaaagttatgaatttgaatgtctgtttcttctttggacttaggcagaagctgaagcctcattgagttatgtggcttacttcgggtcctacagttagttagtggcagaggtggacttgctgtttgtgtgagtacacaatctctgggatttactctcttatttacatgaaagacaaaggacatgagttctgaatgaatgaactgtggtatggtatgttctccataactctcattaatgtcaagttttaataagaaggtaattacatataaggacttacttaaatacattttatcatttcagtgattcttaactaaattgttcaaagtattttgtaggtaaatctatttctctacattccttaaaactaatgagatactcttctatcataatgcaacttttttatgaaactgtccctgaaatagaggctatattgacagaacaaattaattcgattaattcatttcttcctctatcacttttccatttgttttctattattttcttccttgaaatacagaaagctgactatgtggttatatataagtatctagtaaaagagcaaaatttcagaggattgctaagcagaaaagggtaatctcccaactctgctcttacggtgtatgtttttgaggaggatggctagggagtacaggagaggactctggaggtggaatttgataggactggcaacccaggaagtgaccagaaagcaagtgacctttgtcatttgggtaaattattttaggtatggctaggtcaaaaggaattctctttataccccaaatcaggattatctataaaaccactctcattgaaataatgcaaaaagaacgtctttagataaaacattctatagcgagaacccaaaaagaatcccacctacctaagtttgcacaaacatgtgcattagtaagtaaggaaagacatagccagaactatatgcaaagagttaattttgcctatcacgggccaagtttggacacagagagatttttggtaatcagcctataagtcttcttatgagagggttcacaggctgaattgacatggtctgactcattgttgggggagtgatggcagaggacataggagatatcagtgctctacatgaatcctgaggagcacagaagaaaaggaaggaagtgatttcctttagccatgtctagtcaaaataaaagggaaattttctcaatagcaggggaagttctattactctagtgatgcctgttcatttacttgtccctacatcaaacagttgttaaaaacctgcattgttcttgatgctgtaatagatagtcagtggaacaaagaataaaacacagacacccctccttggtgatgtttttggtctagttgcctttatgacataaagtaacctatttaatgaactatgtatttcaatctatagtaggcagagctttttactgactttataaaccccttattaataaagcacccacacactcacacacacacatgcacacacacacacacacacacacacacagaaaacttctgatatattaagggaaaatttactgggagagcaggtcctcaaatcaacagtttcacttgagattcaggggctcaaacatgatggaacaggtaattaccagtgcttgaaatgggtacttaagcaaaattgcatagaaggaagtattttctctgttacataatataaatgagacctatttatttaccacttcatcaaactttgtagccagatgtaccttaccttggaataactatgttttcaactgttgcatgacttccttgcattagcacacacgttttgagtttaggccatgttgtaatatttattgatttcttagtttgtgcaaagaacccgtcttcattctttatacgtattaactcatagaaatctaataacattatgtgtgtgtctttgcatattcgtcctgtatgatgaatcaagaataaattatattaaacttactatcaaataattttctttgggttagacttgccttctctcaatttgttatagtgtgtatgtacttacaaagcttagaagcacctaaatatctgatgataaaattctggttttaagagtgaattttgcaatagataactgtttgaatctttaaaatatgaaaattagtgttttgattaagggcacaaaattaacacagtatggcaaaagcattctacctgaatccaagtaaagctgacacagaactaaaaatgacctgagaactaaaaatgacttggaggaaccatatgggacatacggtattgttggaaaaggcttgagtttttaaaaagtaattttaaagccattgtcatagataaactattggtattacttcttgttaacaaacacatttcatctctacagctagttacacattctgagcatctgctaaagctcaaattctgctctagcttcctgtagtagagttaaggattacttgcttttatatggttcatttacatctgtgttatgtgataaaggtggtgatttcttgacgcagcaatatagatgagtttccccattaaaagctctatgggcggaaagagggacctttataaatcactgtgtggtcttctacattgtgctgttttgtgagatattttcctccccagtttggatcggaataacaagcacataagaaattgccaagagcattcagaaagaaagcaaaatcaaccaaaacaaacacagtaaagtctaatattattttaagaaaaaagttctgaaaaatgcttgacccaaatgaaatattttcaagggtattgccaagaacattcaaatgggaataggtgtgtgtgtgtgtgtgtgtgtgtgcatgtgtgcatgtgaatatatataatatatattttagagcaggaaataatagatattaaagttataataatactagtaatagtagaataaatcatatttattgagtacttactctgtgcttgaaactctgctaattactttcccttgatttaccccacaatcaccccatgcagttaatattacatcacagttagtattatattgcagatgaggcaatgtatgactgccttctacatatttactagaacgtattgtaaatgcaccatgatactttttttggaagtcacttctcatttaggtaaaaattatttgccaagacataatctccctccccacttttaatggccatacctttaatcacggccagagaaagtggcttcatatatatttcttaaattaaaaaaatactatactaccagaatttgcattaactctttcctaccatctgtttcctttgatgattaccaacaggagacatcaattgagcagtgactgcatataaagtacagattcaggaagggttaaaaatgaagagagaaactgctcttccaccacttacacttatacactaatacatacataacagacacacacacacacacacacacacgtgtacgtgcacattttatttcaaccttatgatactaggttcaatatcttccagagaataccattggccctaagagagttcagctttaatagatattgaggttaatttatgacaaggggagagattttatcaatagaatattctggttcattgtcaacagtgttgtaaatgctttagtactatagaatcagatctatatccatatggtgacatttattcacttcacattttctcaaagtgactaaaatggatgactcccttaaacatggaacttgttattttataaatcatttggacaatgatttgtgagaaggtctaactggggcatagaatgggaaaacagatacgaaaatcacattatcacagggatgccattgtggaggtcatcttacacctatagtaatctcttgttgaaaaaggaaggaagatgtttcactgacctgagtatcagggaaactgtgtttctcctggattcttaaatgtttatgttcattgtgcttacctttttatttgactgccagaactcttagtttaatttttgattcaccatcagcaattttaaaggactattaatgtgtttttcaccatgttgatctttgtttttctctttgttttctgtttacttaattcctaaatttttattttatactttatatttgtttatatgtatgtatactatttacatgtgtgttcgtgtgtacatgtgtatgtgtgtgtcttagccacaagttccgtatagaatgaatagaataagacaggatattaacacttaaaaagataaaatcaaccagccttctgacacgatgtctaccacaatatatactattttattatatattattattattctactaccgtccatacagagagatgtgtaccaaattttttccctctaaataataaaatgaaattagagaaaatgtgagcaatgacacatcctcatatcctttataattaggatcttacggagagaccatggaccatcaagccaaaaagccaaaaagctgtggatcccagtttcatattattgcaccatgcacattcatattgtaaacacaccatgatacatttttggaagtcacgtctcatttaggtaaaaattatttaccaatacataatctccctccccacttttatttctttatttttatttttttatttttattttttttgaagtttgtaatagatatgcatggctaaaatttattgttacattaatcaatatattttataaattgggagaaaatattaaaagttcctccccacttttgatggccatatatttaatcacagccagagaaaatggcttcatatacatatttcttaaattttaaaaaatacttatatttccagaatttgcattaacttgtgtcaacttgcacaaactgcccaaactccaagagctttctcatatccaaagtggagataataatttttatttgccaggtgtttctaaagattaaatgagattaaatatatttgacacatagtacaggctcaataaatgcttgttttttgcttagtcttcctcatggaaatctccattcacaagattttcactaaacacacactagacattctgaaaatgattaataaataaattttgagaaataatttatataagcctattttcctttattgaaatacattgcacggggaaaattcactataactttacatccaaaaaggttaaatgcttaatgaactctttaaatgatggtgcccaatgcttgtaaagatgcacatgtgtgtgtgtttctgtatgttgaggagtgatcattctcacacaatgctaacataaacatacattaatttggcacagattatctgaagtattatttggacctctgtattattatttttattccagaaattcgatttctaagaattctgactaaaaacaattaaagaatattcatttacaaagatgctcattgcaataccatttttaagtttatattagtctgttttcatgctgctgatagagacatacctgagactggacaatttacaaaagaaagaggttcaatggacttacagttccacatggctggggaggcctcacaattatggtggaaggcaaggaggagcaagtcacatcttacatggatggcagcaggcaaagagagagcacttatacagggaaactcccccttataaaaccatctgatctcgtgagccttattcactatcacaagaacagcatgggaaagccctgcccccatgattcaattacttcccactggatccctcccacaacacatgggaattcaagaagagatttgggtggggacacagccaaaccatatcaaagttttattttctttttaatttacaaataataattatgtatattttgaggacaatgtgatgtttggctatttatcataaaaaattgggttagaaatctagatgctcaacagtagatgattgggtaaagtggatttaaatgactattaaatgaggtggcgaagtatatttcttgacatgaacagatgcacatagtatatgctgagatttaaaaaaaaaaagatcttgaaacgccatttatagagtcaccatagttttaaaaaataaattcacacatctgtgaagaaaaatacctgggagagtttatttaaaagatgttaagaataggtatggttgtctctgttatgtggtggtgatttgtactcatttagcataccaagattttctcatttttcagtgatgaactgatgctactgatataatatgaatgaaaagaccgctgcctaaagtcctacctattttcatgttccttctggtttttgcttcacgggtggtgcattcccaggcaaatggttcagaaaagaactaagcatagtgcatggcgtgttacataatcccagctttgttttttaatagatgtacttgagtgaccttaaaagcctaaaaatgcaatagttaagagggagttgtgtagggagggtgacttgtgatgttatcagcagtatttagattctatctttattcaatttcaagacatgctgctattggacaagactgtctattctatttatttgttaaaatacaaatcagttctcaaacaagtcacttagaacaagttttgaaccagtttgccttcacttttgattacctggtagtgttagaggcaacttgatgcaaatctgtaactttatttttttagtcattagagtagtgttatctatacatgtcttcctacatgtctagaagtacacactaagtagcaagtagtacattttctacttgcaaatagtatcacatattttgttcagcaatctaaacaacccgctaatgcgctgagatgtaatgcaaaccctaagtattcataaatgccgacttgaaatcagcatgggaatgtcaggtttctcagacaaatttcacctgcctaactttgtttctggctcttcaactcacagtagtatttatttccctgtcctttaaatacatacacatatacatatacctactccagtgttaaaggggtctgtaaaataccttagtatgctcttattgagaaggcaaagaacaaacaatgggagatctgtctaagaggtggaaatgtctagggtgtacttcctcaaaacattgcctgggcttgtaaaatgaagtggtttggaaatgggttccaccctcttctactgacctttggcttctatatgtcttcctctctggccactttctcaaaatattccttcagaagccttttactcaacctaaaaatagctcccagatgctaccttactttgcagtctctttcccgcttactgagattgtatgattaggaaagatagcaggaagagtgtaaggacaagacctttttggttcaaaataagttcattccttagcagagcctttcgtgatctccatgtgaatagctcaaaaatgtagacaactgtttcctgtaagtttacttataaataatgtttgaaaattttagcaacttctttggtttaaaatctaaaattagatgagagtatttgtctaattttagatggagttgtcttacatattaaactattaagtgacttaaactctgtacatcaagtcatctgctaaacttttcattgaattctctgcttacatttccagcaaatgtatcctgttttcctacattttatgtttaataactatcactgaatgtcctggcaatgtggtgaataagtggtttaatcctggccttccattctaggaatgaaagtcaagtaaatacaacagcctttgcatcatgtatcttgttgaaccaacttatgttttgaattgggcacaatgtttcaaagggagactttattaacaaaaaaatagatatttatagtaattcctgccctctactcatgagtcatgtgggtaatgcttgtgattttgttttcgttgttaaatattccttacctgtggtaaatctcatgataaaaatatttgcaatagaagaggcagtgaggctggattaaatcacaatcaaggcttttatctccaagaaagaatctggtagaagaacctccctcctcattagtctcttttgtcagtattttcaagcatggcaacagcctcagaaagacccaaaatacacaacttggggattggaatgaagccacaaaaagcatgtttttataaggacaagaagtcagaaagttgatcttcattggtttcctgcctaccatgtgaaatgtacctcggagatctggtatatgtatcagcacatcagcagatgagagagcaacatgattgtattaataacaaagtttattgtgtatttctttcaaatgaacaaaaattttgaaaaaacttattacaggctcaaaaatgtcctttgtgttgttatgtttaagtcaaccaaacatgatttggtcaacgttaaaacagaaagctgggtaactgttgaagtcacaaatagttttctgcgaacttggacatcttgagcaaagctgagatgtttgcataatcttttctgtagcaacaacattccacatgcatatttctctttaaaaagaaactccaagctcagtggtattctgggttcaaggcctgagtaaaaagcatctcaagtcaaaagtcctgttctaaaaattgagatgtagagaaggtcataagcgttttgacttatcttttaaatcattcatggatgattaaaagtcacattgactcaaagtacaaatttacttaagtatctgaactcaaactagctcaatttcttcttcaaaatcctctaaaatgttttaagtttccacaaacaagataaatccttatacataatactgagcaaaggggaaggtgaaacgtacaacaaaacctgctttcataaattgttcttaaggtctggaaataaaaatgttaaatgtgaccttttactttagtggcatttttctaaaatacaagtctcaaagtgtatatgatgtaaaatgtattattttaaaatagaaatataaaacctagagaaccaaatgtataaaatgaaatgtaaatctcgaattatacctatcttgagcatcttactttcctaggtacttgatcatgctaaagaatgaaatgggatctgctaaggaatgaacttattttgaaccaaaaagttcctgtccttacactcttcctgctatctttcctaatacttcattaataaagcagtatttttatgataaaatgacttttctttctgctttgagccaatagaagatgtgtcaaaaattgtaacttgtaacacagtagagttgtgtcatatgctcttaattttatgaatttaactatgtggctgatatcataactctactagtatgaagaataaaaattctacacaatatttatgacatatttttctttatgatagactatatttattaggtgattacacattgatacatgtcactacatagaggtatatatgcaaatctaaaactcctgtgtaagatgctcccaataatctaatgtagagatggcagagcaaaataattagcacatatgaatgtcttcctgtcatttggaaataataataaccagtttaataatgattataacagtaatagccaacaaaagtatcctaaggaatgagatagtcaaccaactaaccaagctgtcatattgaatgaaaattaaacatcagtggaataaattataataaagattatcagttaacttagctttccacatgaggcttctttgtggtcgctgaggtgaaaattgaacctaaacactccaaattagtgccattagcagaaatgtacaataatagataaagctttgccaatcccaacttttcttttctgaagggaagttacaagcacacgtgtcagctctaccactagcctgaaaccaggcagctgaattttttatatctcatagtctttgtcaactcaaattattaatatttggataaggctctttaccagaaacgagtagttagtttcactttttgaagtttaaaccactcactatgcctcccaagaagtttctgatttgggaaattattcacactcaccccacacatacccactacacacacacacacacacacacacacacacacacacacacaccaagaggggaaaaaaatacctatgaaagcattttcttggacattggcactgcagatagaagtgagttagtaagcaaactgttccagttcctcctcctataaaagctattctttaaaaaaatattatgatcatattgagtgtgaaaaaaataaaataaaaggccatctgatttctgttcagtttcaagtttctgaaactgatggccaagttgggattacaacaattattgtccatgtgtagctgaaattccagtatgtactgataaacaagatttgactgatgttgcagacattaattacagtgatctgctaactggccttctggacttaattgggcattttatgatcacattctaacatgcaagacttatacaagagtaaacaatgagtttatttatctttcagattccaatagttgctatttctctattgcaatgtgttggaaaacctgctaatagaaaatctgccttgtaaattcagcttgtgatattaataaatctgtttctcaaaagttcttaggattgtccatgtcaaaagacagtctgaattatttgacataattatgggttagacatgcttctagtcaaaagagtagaagtatactaaagtataaaatattttctaaactaaaacaaagaaaaaataatttaaaatattttcagcaagatttagtaactatgtctagtagataattattggtgagtgtgaatgacattacctctaaggaatgtgaatatatatatttttagattctaaatgcatcagaatgttatactatgtttgatgcaacaatataacattctgttataaatagaaaggtgaactctaaatatcagcttcttcctctccactaaataaatattaaacacattgaacatgagcccaggaggtctaacattaattgaaccattcctttgtgctaagtatcctgtcaactgcatgcatgtattatctcatttaatcatttcaataaccctatcaaataaattctattattcctcctttacatatgacatacgacaaaactagggccccaaaagtttaagtaactgacagaaaatcacatagcaagtgtcacagcccaaattcaaacctagaagagtcaaacttcaaagtcaatgcttgtgacgccatcttaagacaacctgagcatcgtcccgcaactttctatttcttgtgatgctcagtgcattagaagggctgacaggtataactctgtatccttttgtcctctccctcaactcctactctcttactcaatatcccattcagtaacttttggcttcattttatatttaaggagtaaacttgtccaagagctccgcaactccatggagcttttaaaacactttaaccaggtgaaaaattttcagtcaataaaacaaatgaaaagtagattatggccaggcacagtggctcacgcttgtaatcctagtactttgggagacccaggcgggcagattacttgaggtcaggagtttgagaacagcctggccaacatggtgaaaccctgtgtctactaagtcagccggaaatcccttgaacctgggaggcggaggttgcagtgagccaagatcgtgccactgcactccagcctgggcaagtgagtgagactccttatcaaacaacaacaacaacaacaacaacaacaacaacaacaacaaaacaagtagattagaattcaactcatattatgtgggaacgaggaatgcataataccctatatgccctactagcaatgtttacaacagttttcgtggtcagacctcaaagatgaccattttcactttatattcgccaatataagctttagacttcttcggtacatggtccaacatgtttgcataaaataagttattttttgtatatagtcttagacttttaaaaatatgcttcattgcctttctagaatgtcattgaagtagagggaaagtggtaggatccaaagacgcatcaagtgaacagcacagggtgttgaatgaaaatttaaattgactcaaaaactcattttcaatgttctgcccttttctttagaaagaaatgaaaagagaacaaagggttgtttgttgactaagtgccaaaaacttctgtcacaaatttcatgaactccaaatgattgttggcagacttgacctgcctatgaaaacacgctgaaagcatcatcaccatttcactacttgtttttagacacccatgtctctgggttatgcttccattccagggacaaggacacgtctgagcatttcacagtacgaatctggtgaaatactccaggggtcctaaaagtagaattgctcaacatttcccagatgtggggatgtataaagtatttacttctaattctgcatttataagcacattctgttttgtagcatgtatatattcccaatccttttgggggagaggggactgttaaggagtagggatcagctacaggtgggatcagagatgagaagtttaagcagaagctgtatgtatagaccatgtctttgggagaattaaaaaagaaaaggcaactggctgcctattttgatgtagtaaataaaactaaaaatgaaattagataaatctttcataaaatagattgaacctgtgcatttataactcaaacatctgtgcacgtatagatgagtgctgctttgctattgcatgaatgaacaactccagatcttggtgtaactctgccactgcttttgactctgatctgtgtaaatccctgctgcaaaatgaaaagttttctacagaaatatttctgcaacaaacacacacaaatatgcagagaacatgatgtgctagtcaaattgctgcctgcttgacacacatggggataagaaggaaaaagagcatttaattcaattacaggcaatttttatgatcaaataagccaattccagttatctctcatttagatatgattttcagttaaatcctaacagacataatgcttcacaagaagatactgtctggatagagtccaacgcagaaaatttgtgttaatgctctttaattaaactaagcaatttatcttcgaccttttgttagatttggggagtaatcaaaaattatgaagttcctttgctaactccatatattgcctctggttgcctgactctccaagggtacttgaacctcatagccacattgcagtgtgacagatacacaaagctaaacgaaaaatatgaaacatctttatggaaagataattttatctaaatatgtgtaactaaaaacctgattttatatttgaaaactgattatcatatttgtcactatcttatttatttttataaattttgagctgggctagatcatttcaggcttgacctacagacccttgggatttcatggttttctctacttaggagcatttcacttttgaaatttgggaaactctggtaattaattacactaggaccaacataagttaagttttagtaaaaggtacttatgctattaaaaacctgaagctgtaggccacttatctgtattcacaatagatacctaaagcaactcagtatttctttatacctcttaattcttactattaatcagcttaagattcggtcctatcacattttaatttgtccaagtcaggatactttttacaaccaaagtggtaagaaatgatagcatcatagtttaattggcagtattttcattttgtcacctaaaataataatgacacaaccactggtgtcctagaatgtcctagaatcaataaatacattaaaaatcatttaacaacttcactgtattatggatttaatattaccaagcctgtcatttaaaacccatcacttttaacctatattcagataggatacatgctgtggccaaagtacaccattaacaaattctggatgctaattacattttgcttgaatagttctattttaataaatgaatgaatgaatgaataactatgtaaataaatgcatattgatggtatggggcgatctctctacacactgaaatatacacaatgttagatagcattgttttcaaaacatgccaataaatgtattattatcattatttcttattgaagaatacagcaaagaagtccaggaagtgtcagtttagtaaacaaaccactagttaagaacatttatgtggtcaaagctttattcattgctattataatgagcacatgagtgctttgccttggactatataaaccttctggaagacagaaggtcaggctatgtctagtttcattttctcggaagttagaaacagtaaagttcattttcttggaagttagaacaatcaagttcaattaaaccctattgtttaattgaaaaataagtgcatgcttttagaaggtaatgatgaaaatgacactggcaatgaaaatatgaagagggagagaaaacaaggaccaaagctgaaggctaaaactgaaattggttctgggaggacttctcactgccatctcttaagcagtacagattgtgtctgggtagcacgaacataattcaagcctcttgtgaaggagtcaatatgaactagacaatttggttcagccatgcaaaaaaaaaaaaataggatcacaatgtaaaaaccacagattcaaaaagggagtttttagagcaaacaagcagagaggacatttaaaatccaggggttgaatgcataagacctttacaagtgaggttgctggcacacatacttcatgtcacaggtgatcatcaggattccattgctggggctccaaggataaaagaacaaaatgtgactagatttggaaggtcttttggtagtaagggctcatcaatcacaaaccagcacccataaaaacaatttcttgaggctattcaattatacatgtatacaaccctcactacaaagtaaaaacttttaaaagagattttactttttacaatctgtaaactcacagcaagcagaaaacaaccgactaaccaaccaatcaacccttcccaatccaaaaacaaacaaacaaaaatatcaaaactgttataaagagggaggaaagcataaattgagtgccaaaagttaacctgtttcccctctcagtcccttagacttataaaagaaagttgacatttctgtccctatagtgaggcagccttctaaggtagtcctaattgtctgggatcctaaaattcacatactgtgtaatcccctcccccggtgcatggacaagattgagtgacttactctaatcaataaactggtaaagttgatgggatgtcacttatatgacatggtttcaaaaggtatttctttcatctttctggtagactcttcactgccttttcagcatgcatgctttgatgaagtaagctgaatgttggagaggcccatatggcaacaaactgtggtcctcagctcaactgcccacaagaagctgaatccgagtgagcttggaagcaatcatttccccactcaaacattcagaggaggcctccacccctaactaacaccttgattatggcctctgagagactctagagcaaaggacccacgtaagttgtgcccaaattcctgaaccacagaaattgtcagataataaatgtgtgttgttataagctactaaattctggacaatttattatgtagtatagaaaactaatgcagcccccaaatgtcctcctgagagttagaatatattccagttcatctaggatcaacaagcattctattaacaacatctttccaacagtaacacaacagtctgtgagtaaacgtagagcagtgactttgtcattgtgccattatcttttatttttaatagaaacctatggctgcagagtaaattcccttaatcttttttgaataaaccaatatttaaagataatgtgattatatatataatcaattcccatgtacagctgctgacaaatttagggtactcatatataaccttttaaaaagtaaaagttccctagaataaattaaagaattgccttaaaagctacataaggatttctctaggtaactttcgtagacatgtagaatacattacaaggatcaagaaactccagatctcaaattaaataaaacatatattgaatgcactataaaatccagactgtttaaagatgaagataaagttagaataattataatttttgaaatatagggagacatttttgaaagattctgggacttaacatttgcttcagtttagatctggcaataattacatacgtgagagccaatttagtgtggtgagtaagaacataaattctgaaaccagccaacctcagttatttttcttgctttgccacctgcagctttgagacattggataatctcttcatgcttgtttcctcatctccaaaatgaagatgataagagcatccacttcacatgaggattagaggagataatacacatatagtatttgaaatggtttctggcatatggtcaagggttaaaaactacaaaagtgatcctatgaatatgacttgcctctatgcatcatggtttttccaactacaaaataagagcttgaataagacaaattttgaatgtaattttcagtcttcaaatcttgactatttttgtttacactcgctgaaaatacttgaaatcagtagaaaaaaagtgtattcattcatttattcattcattcaatacacatttatcttgtccctactatattctaggtggtgtactagatgctgataatactatgatcaaagcctatccctgacttctaggagcggatctagaaaaatagcataaggtaattgtcaagagctcagcctctagaatcacgctctctgaattttagggttttatgacgttggacaatttccttaattctcagtgccccaacttcctctcctttgaaatgggaatgatagttacaatcccgtaaatttattgtaaggatcaactgagtgaatacaagtgaagctcatacatggaacttggagtaccataagtattcgataaattctactattgtcaggagaagagtcagacaggaaatcaagcacagtgtggtaagtgtgttgatggtggggtggcggtggaggactgtgcagtgcacagggaactagagcaggaaaacaaagaggatgcccaacacatggggggatcaagaaggttttccagaggagccgatatttggtctcctataaaataattaagagaagtggctgaaaaaggtagttataatatagttaaatatttcagtgtgtcagagtaagagcaatagctgttagtcattcctctttgtgggagaagtgggatttgagttggaatggaaagattcagacaggctcagtggggttaactatgtataaatatacagaagtaagaattcagaatgctctaagaagcatcaaatatattcagaattaatgtcagaactttatggactaaattactaattgttaagaaaatatccattaaaaaacaaatgcattgttaaagaaaagtccacaaactggcaaactgctgcatatattagtaagaaatgttagggatgctttttggctcttccaggtctggaaatgttgttaccttgtcataataagaactaatcacagtgaatttttcattaacaaatataaaaccaattgaattggactaatttaaaaagcatatatctttaaattgcatattatattttcatgcactttgattgatgccgtatttcacaataaaacatttttaaatgaaaaatacttcaatgttaaatattaaagtacaactgaattcatgaaaagtcaccaaagatctactctgctcaatacacactgaatgacaagtctaagcttatactctgtctttaaacatacatcttcgttttcaagtaaatgcaaaatagtactaaatagcatccctcaagattatagccatatgctaggaagaataatccagataaccatattattctcttgagagacttgattctaaatagaatcctaacaggtagcatttcaaatacaattttgggcaagagaccactgtggttcttctgccatcacaccacttacctaactcttcccacagagtaactatcttcaaataggaagctgccaagtgaacattaatttaacatattgctaggaggtgcagttctaggaacaagttccaggaaggacttctatctgggagggctttctaatattctcctctggttagccgttccactgtccttccatgaagagccattcctggcattgatgcatttgagcagaatgcccatcaggggcattgtaatgtggattgtgagaggttggactaagaggttttttgtatggcggaagaagatgaaataaaagacttagaaatttccacttaatgttaggatgcaattcaattacttaaatatccatttactgagtacaaaatataaattaggaatacaaggttttccttggaagtcctgtttatcctattgtcttggtgaaattattaacagagccccctttctatctcaaaaatgcccatagtaggcactagagaatatgattttttaataagggcaggcctcaaggagtctgtgatccagctccacagagatggacaacctggattctatggctggcaagaataatttctggttttccaactaaagtggggttttaccctactaaaagctagtgttatctattgctcctcaaattccaaccctaaacttcacaggcctggcctacttcatacactctgtgtaggttaaagtgagaatataattaaggaaagggaattattcgtaaagccaaggaaaatccaaggatttcagcatctgcatgaacatcggttgttaaaaattataattgaggctgggcacagtggctcactcttgcaatcccagcactttgggagaaagaggccggtggatcacctgaggtcaggagtttgagattagcctggccaatatggtgaaaccccgtctctactaaaaatacaaaacctagctcggtgtggtggcagtcgcctataatcccagttacttaggaggctgagataagagaattgcttgaacccaggaggccgaggttgcagtgagcagcaactatgccattgcactccagcctgggcaacaagctccatctcaaaaaaaaaaattataatcgagaaatatacaaattcaatcccttactctcctgctccaccagtactaccttaagttaggacttccttccctcttgcttgggctataagtacaatgatgaaatgctaatcttcattcatgtcatattcaacatcttgcttggctgaagatttagaacacaggtttgtcaagtgtgcagataagcaaagttgtgattaaaattttaaaataactaaaagagtggtttagaatgttccaaacacaaggaaatgataaggtgatagataccccaattacctttatcgatcattacatattaaatccctctatcaaaagatcacatgacctcataaatagttgtacatagtggtacaactattaagtacctataatgatttaacattttatttattcatatatatatatatataaactgttggaaaagaggctcaagattcttacagttctcaatgggcttgaacaatgagcccaccaaaacgtacaatttaatatagataaattgaaagatctacctttagcttaaaataaaacaaaacaaaagagtatggataagaaagaacaggtataaaagtcgttcacctgaagaaacctggggacttaattgggattttatgatccagtggtatgataaagctactaagaataaagtctaggttgaaataaaagaagtagaatgtccttgggacaaaacagacctggttttctgcattgttaggaacacgtgatctgtgttcagtcctgaagatactgagcttagctctacggtttaaggtaaaattgaccacacaatggcaattaagaacagataaaaaagaaaagaatgcatagctgggcaaaaaggaaatgttaaggaggtaaaatagtcatcctaaagtgctacaacaacaataatgatataatagcaagccattgataaatcagtactttctatgtgctcaagtgtgctagtactttaaacaggtctgctttgactcttgcctaaagcctagatgttagacagcattaaatcccttttatcagatgagaaatctgatgctcggaaagagcaagttacctaaagctacttttataccacatgtttgaaggcatttgtgtagaggagagaaagacctattctttccagagggaaatgaatggaatctacaacttgatacagaagataatttcctagaattataactgcaatagagtggagttgtctgcctcacctaataatcagttctcctttgttgtgcatgatcaagccaaggtgaactgttacgaacagaatctacagaaataaagtattctgtgctcattgggaggtggggctaagtaaactttaggtttccattcaacatttggggttatgattctgacactgagaaatggggtactttcgttgccttgcattatacactatttaggtcaagtaaaaatcaatcaaataataaatacattaaattaaattaaaaagtcagatcaaaccagttgttaggctgaacagacaggtctcttcaatcaaaatagtcattcaaattatcctttgtagtcatatcctttaatctacttctgtgattggttacatttcatttggatttcttattttttaaggcaattttatatcatctacatataatattaatagccagattaataacagagcttttaaccacaaggttatagagtatagttacttaaaaatctgaatgggcatctattatttctgaaaatatattcataccacaactgaaagaaaattttatacaaagtatggcaatagaaaataagatccctcttgaacatgcatctctctggaatataaattcctcaaatattacaggaggcctgttgtaagtggagggaatcctcctgattgagatcaaatcacatagagttcacaagagaaagttacctgtccaattggtatatttgagctatgtgtacacaaccagttttcctcccctgttcttgttaattgtttgagaatcaaatccaatggtaaaaaagagaatagtaactatagttgcatgcttgaagcaagaatagtgaaattgggagaacctagacaaagtacttattagttggtgaggaaaaaccataaaactacagggttttctttatatagacacaaagacagatataggctatagcaatacaaatttaactcattcatttagtactttttctttgtttgcaaatatttatagtgtctaccatgtgtcataggtgctagtggcaggcatgaatgacttccaaggaccagtctctagtatctagggttcacatttaagggaatgcaaagtacatttttagtacctgaagagtttatatcttgaccaaatccaatcttttattttgtattctcattgtcctgtgtatctcttctctgctgtgttaacataaaatgatttgtgtgaccacttgattgatattcagttcctcactggagtatacatccattagggtagaaatgatgtttgtttgtgctcacctttgtctctagtgctttaccacaatgcttggggggtacacatgataccactcaataaatattcagtgaatgaataaattaataaatgcaaccttggagaacaaattgttatgaaccacagcctttataagccatatgcaccagctctatgacaggctttgttatatacaaagaaagcatttgcagaaaagtccatgccaaaaccattctcacactgttggagaaaaatatcattaattatgtcatctttgaaaagaaagaatagcaataaacccagactacacatccgccttaaattggccaaaatctcaaatgtttttccatccctactttatgcaattttatcactgcaatacatgctttttttgtaaagttaagctagatttctggcttttaaaattgtacttcataagctcctaacacacaacaggtttgtcatgagttaccaagcaataagaattgacatcagacaatatggataacaccatcataccacatcttaaaaataccttttcacaaggcatacaaaaagataacgtgatgcagattttgcaggcttgcttgagtgttgcctttaaccactctatgtaggtttaaaatgagtagacaatattccacaattgatctgtgtacaatctgtaaaatgttccttataactgttatagaatagaggcatcaaaaccatatccatattcacaaaacaaaatgctttacagatctgatgtaatatttttaaagtttgagaatattttgttttacaataaatattcaataaaatgatatagttctgatttcttgttatagtacaatatgtagcccttttaatgattgacaaaggaaattaatatgtttttgaaagaaaaattctatatatcctaagctttcttactcaattttgaagactttagtttcaagggcttgaaacaaagacatttatagaggttgtaattattatgttaagtatgtgctgttggcaaacttactaattttttatttgcattactgcaggaggataatagaatacatcagattatagctaatgcatcctcagtgacctggcaaattcatttttctatgttcacaaaggtctggtttttacaagcataaactttctttgtagattctagatattagccctttgtcagatggatagattgcaaaacttttctcccattcagtaggttgcctgttcactctgatgataatttcttttgctgtgcagaagctctttagtttaattagatcccatttgtcaattttggcttttgttgccatttcttttggtgttttagaaatttacaagaaaaaaacaaacaaccccatcaaaaagtgggcaaaggatatgaacagacacttctcaaaagaagacatttatccagccaacaaacatatgaaaaaaagctcatcatcactggtcattagagaaatgcaaatcaaaaccaccatgagataccatctcgtaccagttagaatggcaatcataaaaagtcaggaaacaacagatgctggagaggatgtggagaagtaggaacacttttacactgttggtgggagtgtaaattagttcaaccattgtggaagacagtgtggcaattcctcaaggatctagaatcagaaatactatttgacccagcaattctattactgggtagatacccaaagattataaatcattctactataaagacacatgcccacgtatgtttattgtggcactgtttgcaatagcaaagacctggaaccaacccaaatgcccatcaatgatagactggataaagaaaatgtggcacatatacaccatggaatactatgcaaccataagaaagaatgagctcatgtcctttgcagggacatggatgaagctggaaaccatcattctcagctttctgtgcaaactaacacagaagcagaaaaccaaacagtgcatgttctcactcgtaagttggagttgaacaatgagaacacatggacacagggaggggaacatcacacactggggcctgtcaggctgtggggggactaggggagggatagcattagaagaaatacctaatgtagatgacagatagatgggtgcagaaaaccaccatagcacatgtatacctatgtaacaaacctgcacgttctgcacatgtaccccagaacttaaagctaaaaaaacaaaaatcataaactttcctgcatatcactgtcctgtcacccataaacattagaaagtgtcacatatttcagtatgattttaaagcattcttcagattggcgacgtttgaatgtatttttttgcaggccttttacttttcaagtgactcactgtaaggagcaagcactgcttagcttagctattctcagatttttaatgagaaaatattcatgttacaatagaattatctgatttatcatcttaaggtctgtagaaatccattgcataccacaaccatacttgtctatcaaattcagagcagcaaacataggatttgtttgtgtgtttgcttatttatttatttcctcaatttattaactaatagctatacttttcagatttcctgatgttattttttggtccataatcccatccagaataccacactacatttacttattatgtctctttaggctcctcttgcttttttgatgacctaaacattttagaggaatactttataggtattttgtagaaataatgtccctaaattgagagttttctaatatttttctcatgattagattaaagttatgggttttgaaaaagagaacacagaataaaagtgccattctgtagtattgtcataacattggcaagcagacatactatcaacatgacttatctctgttgacattgactttgattacttggcttgaggtcatgtttgtcaagtttctccagtgcaaagttactctttttctgtcttccattacagtgctctttagaagaaccactatgagccatccacacttaatgagtgaggagttatgctcacctccttggcgatagagaagctacataaactattttaaattcttctgcataggaggttttttcactgtatttgaagaagggaatcttaaagcaatcatctgactatcaacaaaccttataggctaagaaaggtacttaacgtttgttgggtaccgttcttaagaaaaatatttaaaaataagaaatggctataatttgttaaacatattctatataccaagctttgttattaggcatgctgtgattctcatctcataaaaccactataggaaccttaggaggaaaccattattattctcatttcatagacacagaaatttgaagttaaacaggtaaagcagcctgctcaataaacacctataatccatcacttgctgaaaggaaaactactcacacatacacacactcacacacacatacatataagaacattatgtcttataaaataacaccttcccatacaacaaaagcaggaagcatggcagagtgtgatttatctttttgttaaagaagaaaagtgttggctaattggaggtttgtaattttgccccatttatttcccatcataaagaatgtaaatgactcccccatctccactaccaccagtactggatatccctggtttgagctcttcaattctccaggggttgtggtcatttaagtgaataagacttcatgacataaaatcatgagaatgcaagaagagtatgggtttttaagagaatgtaaatttcccattgagcctactttatttctaggcataaatatgtgtttgcttaaatatccacatggttgatgtaacaaaaccattattctttctcagcaaacatggaatttctgttttcacagaaccaggtttctattcaaacattttatcataaactggcagaactaccaaagcatgcacagtcttaatattaatcaggaatttctttttcctatacaagtcacaaaaagctttataaagcatgatccgcttgctatatgatgaaaagcatttcacagtttgctattacagaattcacatgcctgcaaacatgtaatgacccaattgaaaacacaaggtcagagtcaggttgtctaaaaaaaaagctcatatgagacatcttggtgagcaaataaatatcacttaatgtaccttaatgcctctcagacagactcttagtacttaaattattcttcactgaatttgttaataattttattttcaaaatggaaccatagagctttactttttcagtaggattcactcaattctgaaggatcaaacagacttaaaagaataaaatcatgcctttaggtaaatatgtatgtaacactaatggaacagtgcagtgtatatcctgcccgatagtattgtactgtacaagtgtgtctgtttaagtggacacaagtcacaatgtaaggctcattacccttagacttagtaagtaatttaactcaagtcctgaacattctctgctgtaaaacctgcaaatgcatagggatttgcaaagggaacgggaatggaatgtgagacaaatgaaacttaattgaccaataacaagttctgaaattgaggcaataattaatagcctaccaaccaaaaaaagtccaggaccagatggatttacagccaaattctaccagaggtacaaggaggagctgggaccattccttctgaaactattctaaacaacagaaaaagagggaatccaaagtaactcatttcatgacgccagcatcatcctgataccaaagcctgacagagacacaacaaaaaaagagaattttagatgaatatccctgaagaacattgatgcaaaaatcctcaataaaatactggcaaaccgaatccagcaacatcaaaaagcttatccaccatgatcaagtgggcttcatcctgggatgcaagtctggttcaacatatgcaaatcaataaatgtaatccagcatataaacagaaccaaagacaaaaaccacatgattacctcaatagatgcagaaaaggcctttgacaaaattcaacagcccttcattctaaaaacgctcaataaattaggtattgatgggacatatctcaaaataacaagagctatttatgacaaacccacagccaatatcatactgaatggacaaaaactggaagcattccctttgaaaactggcacaagacagggatgacctctctcaccactcctatccaacatagtgttggaagttctggccagggcaattaggcaggagaaagaaataaagggtattcaattgggaaaagagaagtcaaattgtccgtgtttgcagatgacatgattggatatctagaaaaccccattgtctcagcccaaaatctccttaagctgataagcaacttcagcaaagtctgaggatacaaaatcaatgtacaaaaatcacaagcattcttatacaccaatggtagacaaacagagagccaaatcatgagtgaactcccattcacaattgcttcaaagagaataaaatacctaggaattcaacttacaagggatgtgaaggacctctttaaggagagctacaacccactgctcaatgaaataaaagaggacacaaacaaatggaagaacattccatgctcatggataggaagaatcaatattgtgaaaatggccatactgcccaaggtaatttctagattcaatgctatccccatcaagctaccaatgactttcttgacagaattagacaaaagtactttaaagttcatatggaactaaaaaagggcctgcatggccaagacaatcctaagccaaaagaacaaagctggaggcatcacgctacctgacttcaaactatactacaaggctacagtaaccaaaacagcatggtactggtaccaaaacagagatataggccaatggaacagaacagagcccacagaaataataccacatttctacaactatctgatctttgataaacctgacaaaaacaagaaataggggaaagcattccctatttaataaatggtgctgggaaaactggctagccatatgtagaaagctgaaacaggaccccttccttacaccttatacaaaaattaattcaagatggattaaagacttaaccattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaacaaacagcttctgcacagcaaaagaaactaccatcagagtgaacaggcaacctacagaatgggagaaaatttttgcaatttactcatctgacaaagggttaatatccagaatctacaaagaactcaaacaaattgagaagaaaaaagcaaacaatcccatcaaaaagtgggtgaaggatatgaacagacacttctcaaaagaaggcatttatgcaggcaacagacacatgaaaaaatgctcaccatcactggccatcagagaaatgcaaatcgaaaccacaatgagataccatctcacaccagttagaattcgatcattaaaaagtcagtaaacaacaggtgctggagaggatgtggagaaataagaacaattttactctgtttgtggtactgtaaactagttcaaccattgtggaagacagtgtggcaattcctcaaggatctagaactagaaataccatttgacccagctatcccattactgggtatatactcaaaggattataaatcatgctgctataaagacacatccacatgtatgtttattgtggcactattcacaatagcaaagacttagaaccaacccaaatgcccatcaatgatagactggattaagaaaatgtggaacatatacaccatggaatactatgcagccataaaaaaggatgagttcatgtcctttgtaaggacatggatgaagctggaaaccatcattctcagcaaactattgcaaggacaaaaaaccaaacaccgcatattctcactcataggtgggaaatgaacaatgagaacacttgggcacaggaaggggaacatcacacaccagggcctgtcatggggtgggggggagcagggagggatagcattaggagatatacctaatgtaaatgatgagttaatgggtgcagcacaccaacatggcacatgtgtatacatatgtaacaaacctgcacgttgtgcacacgtaccctagaacttaaagtataataataaataaataaataaataaatttgaaagcaccttaggatcgtcgtttcctcctcacatttagaaaaatgagaatggaatcaatctcatgttatgtaatattaagaattccttgtaaagtcatctgaaattaaacagctccatatgacacaaatgcagaaatatttgcttttttaaaatttagtacgtattgcctgagcaaagcactcttgtgatgaccccagttctaaaatcctagtattatctttgatgaagacttctggtttatttttatttacttatgttcattatgattttcccctcagaattcaaccttttccctagttctctagctgcttctccatccttttatctgcttgcttatttctgtattactttaaggaagtgtcagggctgtgtgggccactctccatagcaccccagcttccaattatccacccttgcataatgcaaccacagaatccaaacccgttgtttcactactactactgtttatgcctatgtcctttaaaagtttgacagtaagtttctatcattttatttgtcaccttacctgtaaaattccattccctaaaactgaattgcctgacctatcacacctactcattcatttatccctgcagtcatatgtccattcacctctccatccattcgtttattaactacaatatggaggatggagcgggagagagttagggaatttgttgggtcacagtttgcacaaagttaaggaagagaaataaatcatgatattgtaacagaactgctacatttagacgtggctggaacataaagaacaatggagaaattgtgaaagatgagactggagtagtaagccagggccagcttataaagatagatttaagagtttgaacttcattctgaggataccatgggtccgtgtgttttcactacggcaatgtcatgattggttctaaatttttgaaaagctctggctgtcaatataatttgcactgggatagatattaagatcttgtgaagtaatttcatacttatcatctcacataatcataacttcattaatctctctctcaagtatttattcctgctttctttgccacattaagtcttggagaaattaatcttgattttatattctataaaactagctcattcactttccttctgttttataacttacttctgttcatctcaaacaaaatttcttatatgtatttcttcctttgaaaaaaaagaataaaattagccaaggattttggactaccccgacccaatttctttctctgtaattcaccgttttgggtgctttcaacataagtctttacatgaaagtaaagacaagggaaagtaagaaataaaaattggtataaaatgaataaatgaccatgacatgagtaaagtaaattgagagctggtcttacaggaagaaagctgcttcggtagtaaaaaatgaagttaccaatggaaaaaccctgttccaaaatatttctcctgttttttttttttctacaagattctgctactatttctaaagatctttttatatttgttttctctgcaacagttattttgaaaaataatgaaaattttaatatggtcaaaatttcatggagtcaagatcccatctgttttacatcactcctgcttcttttatttggcctcagtctaaatatacctattcaaaaaaaaaaaaaatctgccgggcgtggtggctcatgcctgtaatcccagcactttgggaggctgaagtgggcagatcacctgaggtcaggagctcgagaccagcctggctaacatgggaaaaccccactctactaaaaatacaaaaagtagctgggtgtggtggtgcacgcctgtagtcccagctacttggggaggctgaggcaggagaatagattcaacctgggaggcagaggttgcagtaaactgagatcgcacggctgcactccagtctgggcaacagagcgagactccatctcaaaataaataaataaataaagattgctttgattataaaagtgtcaatgcttatattgtacaatacacataatcttcataaaagagaaaatgtttaaaactcttcaatttttccattaaaaattattcattgtgaatgttttgggtatgttccttgtcaatagttttatgtgcatgcctacaaatgcacagtgatcttccacccaccccacacacaaactcagtgctattacatacatacagcttttataaattgaggacaataacagtatgtgtgtatagagttgtgagaatgaaataaaataatatcctaaagtatctgtcccagagtttggttcatactaagtgcccaaaatattagctattatttcagttattcaggtatataacctacttgttcacacaacatctggtgggcatcttctctttttaaaacgtgattttaacagttgcagtcatggggtcactgaagacatgatctttcgtcagagggtcccggattggagtgtcttaacggttctgccacttactgcttgtgggagcttgtatgtgatttccttattcaaagattgtgggtaatgtttatcttccagattttttttttgttttggggattagagatcatgtgtgcaaggtattgaaacaaataccaaataaataatacctattgtttcctgtgttcctgctatggtggctgcaatgagcatgttcatatatgttgctttttccttctgttaaattatttccttgggaatgattcccagaaattggattactgagttaaaagatttgaaaatagctatgttctttgtatttactgttatgctcttttccaaaaagtttcaaccaatatgtaatgtaataagcaaagcacctcatatatttaaagaatgttcctatacctgtttcattcaagtccagattctatgctcatcacttaagaaggggaaaatctgggatagattttactgcaggaatttcaaaccactgggaactgaacagatggtgctaactcattttacgtttgagagatcaccagtcagccatgctcagtaacagctttcagaaacatctggattcaaacttacagcctaaacatgacaggttaagtagcatagagttataaaataacttcatgactagattctcaaaaatccaaattcccagagatttttatgatttttaatgatcagaaaaatttcaaacaatgtaagcattaagaatcacataaactatatagcacttcaatttgatattgtggaattcagagtgtggatggtctatgaagcttttaaaaatactattctgtagatataaaaatactaacaacaattttactcaaaggagcacaaaaatatatgcagtcttccagttatatttattaaatcttactaaacttatgtgaaactgaaatagttaactttttgagaatagacagaggcaataaaaaaatttgcctaaaaacaaaccttatgacatttttatccatgtcataagtcttactggaatgcaatcttctggaaggcagacctcaggtctaatacattgtttttcaatgcctgttatagtgataggcactgcatgtatgcctaagtaaatggtgactgttccagtcactgctattgatttaatataaaggggagtcttcaaaaagctcatggaaagtgcataatatgaaaaaactatgcatgggtttaaaaatgtttgcccaaaatacatttgtactaacttgtaacctatctgaacaggatctagtttgaggcactaagaagaataaggtatctatttaaaagagcccttattaaaacaacataaattctgctaaaattgaagcaagaacaaacatcaaattcatggtgaagtttggttggaagaatggtgaaatcattaatgctttacaaaaattttatggggacaatgctccaaagtaatcagcagtttacaaatggataactcattttaagggacaagaaaatgttgaagatgaagcctgcagcagcagactatccacacacatagaattttttctttgtttatgccctaattgaaggggatcgatgactaacagcatgaacaatagccaacatcacaatcatttcaatttatttggcttacacatctgactgaaaaattaaaattgagcaaattttccactcaacttcatgggtacaaaaccatataacctagatcaactatagacaagagcagagttttcaatggaaattttaatttaaacaagtgggattgagatcctaaagctttctttgaagaattgtaacaggagatagaacatggcttcaccaatatgatcctgaagataaagcacaatcaaagcaatggctactgagaggtggaagtggtccagtcaaagaaagagtggaccagtcaaaagcaaaggccatggcaatagtttttttggatcttcaaggcattttatttgttgactttctggaggaccaaagaaccataacatctgcttattatgagagtgttttgagaaagtttgccaatgcttagcatggaaacatccagagaaacttcagcagagtccttcttcacaaccacaatgctcgtgctaattcatctcatcaaacaagggcaatttttcaagactttccatgaaaaagcattaggcatccaccttacagtcctgatttggctctttctgacttttttgtttcttactctttaaaaatctgtaaaaggggccaggtgaggtggctcatgcctgtaatcccagcactttgggaggctgaggcaggtggatcacgaggtcaagagatcgaaaccatcctggccaacatggtgaaagcccatctctactaaaaatacaaaaaattagccaggcgcggtggcgggctcctgtagtcccagctacttgggaggctgaggcaggagtatcacttgaacctgggaggcagaggttgcagtgagccaagattacaccactacactccagcctggcaacaaagcaagactctgtctcaaaaaaaaaaaaaaaaaaaaaaaaggaagaagaaaagaaaatctgtaaaaggtactatattagtccaatctcatgctgctatgaagaaatacccgaaactgggtaatttataaagaaaagaggtttaactgacccgcagttcccagtgtctggggggaggcctcaggaaacttacaatcttggcagaaggcatctcttcacagggctgcaggaaagagaatgagtcccgagcgaagggggaagccccttataaaaccatcagattccgtgagaactcactcactatcgtgagaactcacccactctcatgagaacagcatgggaaaactgcccccataatcgaattcacctcctatgaggtctctcccacaacacgtggggattataggaactacaattcaagatgatatttgggtgggggcacagccaaaccatatcaggtacttatttcccttcagttaataatgaaaaaaagactgcattgataatgattaaattcccggaccttcagttctttagggatggactaagatggctggtatcacggcttatatgagtgagttgaacctgatgtagcttatgttaagaaataaagtttacattttcatttttatctttcaattattttcttccatgaattttttgaagttccgtcatattaccctccaaatttagtagtttgtaacaactatttgattatgttcattgggctgtcagactctatgagtcaggatttcagaaaaggaactgtagggatgggttgtttctactccatgatgttctgaaccttttccgaatctagagatagtgcaatgggtggggaccagaaagctttgaaggctcatttgctcccatgtctagagcctgagttgaggtgactcaaatatggagactcactaaccacagcacctacacatgccttctccatgtggcttgacttcttcacaacaccatggccttggggtatatggacttctaacacagtagctcagggcatgagtattgtagtgcacaagatgggaattcaattcccttttatggcccagccagattcaaggggaggggaactcttcatgagagggtggcatataagacaggaagtgctattataatcatttaccatccagtcctgttctctacctattacttgtactttttctaccttgttaaattaaaaaagaaataactgtatgtctttacatagctttattactcaaatatggtgaggtgggtgtgttttgttctaacttttaaaaactatatataattttttaaactcgatcttccttaaagattccagaacacctccactgaatgaatgggttggaatgatgtgtccttctgatgaaaatcaccacttcgccattgatttctcaaatgcccagtaatcagaggaggaacaaacatacattaatctcatttttcacaagaggatattttgtatctgaccagaaaaggagctttccaaatatttggtgaattatttgaaacattaaaaaaaaactttaaaataggcttatagagtttatttgaattctttagttgtttatgatatctttttggccataatcttcaaaattagatccaatggaagacatttcaaaatagtaggatactatatagagataatttatgttcagggtaattcatttccctaatgaccttttccttgcaaattgcacaagtttgatttgtgaactcaaagtatgtaagctttagtctcatatgaaacataacagtcataaaataaaaatttctttttcctctttgacaggaagacttcttagtttctctctatattcaattctcagttaagagctttccttgttgaaggctgagtatgagttttccactgctattgtcagcttttatcatttatttgaaccaaggtctccttagtacattagtttatcttgactgtcagtaagagatactgacagtttcaccttcacaagtgtttattaattttcttttctttttttctaagcatagactggagatcagtgactacttttttcatattcttatcatactgatgaacttttaaaaaaattcaaaacatatatggcataaggtcttttaagtgatgactcttccccagaatattacaaatagtacccaatttattaatgttgaagatgttaaatgattctcctctattgactatattttattttttatttgttttttagctgaaagaaatataagaaatacaacctaatactgtaatgaagtgttcctgaacaaaaatacagataagctgttttaaaatattatctttatttgtatgctcatatcaggataactccaactaaggcaatttgtctaagtagctcatttatttaaaaagaaaagtaaaaatagcaatgaattatttgcctctgacatatttgtgaaagttttttaagaattgtgctgggatgggaaagatgcctaggaagcattttccctaagaacatcaggcttcttacagcaatttatacacatgtatggtaaattattctcattgccaaagatggttatttagtatggatagattctccaaaaacttacaagacatcatcattcatctgaatctcttccctgctccccaccattcagaatttgttgtaatttgtgaaagaaaagtgaaagaggcaagaagagtgaagagcttcagatttaaccactcagagtatgggttcaaattctgcaatctgcctcaaagtaaatatgtaaactcttaaaaatcatttgactttagtggccctcagtttccttatctgtaaagtgggtttgataatacctgctatgtattaaaatatttgtttgggtgatgacactgtttaccaaggtagatttattaataccttattttaaaaaatcattatttttttctttttgtttttggagatagtctcactctgtcacccagactggagtgcagtgccacgatcccagctcactgcagcctcgacctcccgggctcaaatgatcctcctacctcagcctctagagtcactgggactacaggcatgtgccagccaccatgccaggctaattcttgtatattattttgttagagacagggtttcaccatgttgcccaggctggtcttgaacttttgggctcaatccaccagtcttggcctccgaaagtgatggattacagacatgagctactgtgtctggcagaaaagtcattttcacacttgctatgtggcagaacatccagtatctattgctctctttgcagataaattattttgtgccgaaagcaacagcaatttctttggcagaaaatgtgattatgttatatcagtagataatcatgtatctcatgtaatgcaagctgtacaactaaacatgagaggtcacttcccagcttcctttaatatgtatttgctgtattgtcagctatctcctgagagatgataaatatcacacacaatagatggaagatgacaaacatggagacaatgaagtgagaaacccttaaaatcaagaaaattgtactctataacttaatagtttcctgcacattggggaaaggtctctgttattcagcattagcacaagtatcctttagacaacttcactgaccaaacagtggcccccaaacagcttgagcaatacagcgtgtgttgattgatgaacacatcccaacagtatctactgggcacctgcaatgcccgcacaccacacattgcttgtgctcagctttcaatagacagcgcaggtcaagcaagtgaatatgcgctgagttgtttgttgttgtgctgttttaataggttttggtttacctcgccatgcaaaggtgggtgaaaagaatgactgaaatctattttgtccccaccctgctttgtcctctttgggtctctatggagaagaatggacagggagaatttagggtagcttagagcctccctgtctcatgcaactgatactcagcaagggaagcagtgaccctcaaaacccaaattttgagtggccaggcctccaagatcagacaaaacgagaggaagaactatcacaattgtctacaagtagcagtgttcttggcttgggcccaaaataccaggaatattttcattaatagggacaatgataaataaaataggaagtgagataagaggtcattgcctaaggaaacaaggtttttcttctcatttttacaactctccaaatgacccacaaaaggaagtgcaggcaaataatattttaagttccagaatgcactttcacttttccaagcaggattgcctacagataaatccaagagggaggtcattacattgaatggaagatatttagaataggcggcttcgccccatgtaaagcaattgtaagcctttctttgtgttttagaagtttttagataaatagtcagactcaattaagctctataacttcaagagatggtgcttctaaggagttacacagtagggactgcagacgtgggattctgcggtctgttaacaggcctgtgggagggctgagagaatcagctattgtgcttcaatcagcaacagagcctacagtgccaccgtcaatttaaccatggagctttagagtgtggatggggacaaatggctgtgtgaaacagaacttgagaaaggggcaacacatttagtatgaaagaattaagggtttagacacaaagacaactacagaaaaattttttagaaataggcttaaggtttgaggattgacaagaggagacatggcaaacgttgctgcagctaatctcatatttggttaagagcataggtcatagagccagactgcctgggattgagtgctggcccataaatttaactactgcgtaatcctgggcaagttacttccactctctgtacctgcctcagtttcctcatttgccacgtgaggcaattataacactatctacctcacattggcttttgaggtattcaatgaattaacacatgtaaagtttttccaatggtctcaacagttttgaaaaagtgctcaatatttaactaacactgtacccagaacttcccctagtaataagtagtatttacgtaacacctactaggtgacaggacttatgcaaagtaatttatgtgtattatgcttgcacttaataactctatggcatagatactattatcacctcaatttcacccataatgaaattgcagcacagagcagtgaagaagcttgcccaaggttacacagcaagtcagtggtgctatcagcattcaaatccaagcagtttgactctaggcatgacacacttcatcactgggctgtactaccgttaaacttgccataggaaatagtggacacaaacaatgtccttgcttttaagtctgtttcagtgggtttaggcttctcaacaacaggggttttagtgaatttcttacatcttcctagtaccttgcagaccaccttggctgaagtgcatatttgattaggtaactggctaactggtttcctgccctttgttaattgcaggtgctaagctctatgactcctgcctgtatcctaaaagcgcatgacaaaactcatgccatccctcatggagcagtcctcctgacactgctatagtcccccgtccctcactgtgtcacccctcccccatgtcccaataaagggacagtcactggtctctctgttcattcaccttccctgtcgtccatcctctttgcagcactcccactccatggccagcatggggaggatcacaggagactttattaaaaacaataatggaggagacaagagaaataaaaaggagagacaggccgggaggtccctttgaatctttttgtcttgcctggtctgagggctgccttgccacctctgctttcctgcttttaatctcagaagtctctaacgtgcagaatgagcaaagtgggggttgaaaaaagcaaaccatttggaagccagaaaaaatattagaactttcatttctaaaacaataagaaagttaataataaattcatataaggcctaacattggagccttcacaccatcagtatattaagcggccgtgcgtcattcatctgctaaaaaaaaaagaaagaaaaagaaaaagctccagagagctaaagaaattgatggggctgcctcacttgattgtcctctttcagcacattatgatatagcacagcttcagtgtatttgggaaaacggactcatggattattttatatagtttaaactaaattaatatttacaacatggacaagtgtcttaaaaaacacaaaaatactggcacatgtgtacaagaaaatagcagttcttgagatttctattcttggtaagtgccatgtattagaagtaaaaaaacaaggttagctaagtagatctaacaaatcatcagagaattttgaaaatatcaaaattcctccttgaaattcagattttctttcactattcttgacaatgaattctgcttgaagtgaatagtatcctttacaatatgaggcaatcatcaaatactacattcttaaggtaaaagtagataagtgtacactatcatacaattgtataattaaaggattagataaattatagaatttgccgctaattaaccaagagtactctattatcttatcaaatttgtgtcatgtgaaatatgggtgggcctcagtattttaagagtctaaaacaatctgcatttgtttttgaaatttacaattggtacccttaaactgctttctgtaaggcagatttggatgttcttacaacagcttggcaacaaattcaaactatcgaatgtaatgtttctttgtgcccaccagtagctaggtttgggcagctttacctaactaatatttgattatttgaaagttttcttgcagctattttgaaactatgttcctttggacatatgggatgccctgcggaatgctcttggagggccaagggaagagggtttagaaggaggcctcactccacttcttctgtaacctctccatttgtttctagatattaaacttctgcggaataattcatttgaaaatcaggttcgattgccaagaattatttaaaattcatcagttcattgattcaaaaatattgtctttattattgacattttaagttattaaatattcaacttattcaataaacccattcatttattctacaagcattagaacaactataaccttatacctttgttcttattatttaaaaactgagtagaattagaaaataataagaagactgataatactggtaataaggttacaattctcaccccttatatctgtgcaattaaaataaggtggatgtcaagacctgctgggtggggcaaaccttgagctacaataaaaacctactgaactttaatctagtcagctctatatcaagagtgaagacaagaacattgttaaaatgttttatgaaatcctggggctatctttcatctttaagggtttagagaagaactataatttgggattttaaaatatttattggttctctgggaatggaaagtctccaataatcttgaagggtcaagcattgtaatttaacttatttaaccttcagaaacaaagtggagactaccaataaagcatactccttcctaatgaatagagctacacacgtcactaaattttacaatatgccatccttcaaaattatcataagccatttcgttgaaatttatagtaagtttacctatctgatgccagtgagtttggtcgcttataggtacatattactagtgatttaagatattcagatttttttcacttgcattttattcatatttcagctgctgatttacttcagacacacctcaatgcctgtgctaatttgcatgttttttcaagagttcaacacaaacttaggaaacacattcctagatagacctctaataagtgacctgcacagtcatgtagtatagtataaacaagtaacaacagttatcttactctatatttttcagtacttactgacaaaagaaaagatcttcataggcctaaatgcattctggatgaaattattagctactttctctgttcaaaatcaccttttcatttgcttgaaggaaaaaattcagattatttgagcagacaactaagaccaaatgaatctaaagctctctcacttctaattatttcgaattagataacagtattcaggtatagatcctacatggaaatagcctccaaatgtaaagagaagataatccatggagggcgtcattctttaaaaacctctttgataagagagggggcacatcttttgtacacattgtaagaagatttaaacatggagatgccctccctccctcagaccatggggccaaaaccaaagggggtttggaatttcccaactccaccgccaaagataatcttgtattgggacaaaagtcgaggatgactcagaatgtaattagggttgtgcatctaagcaaatgacacaatatagcttgcggtattaaaaaaaaaaaaagaagaaaagaaaagaacacaaggcccaggaaaaggctgctaatgtatccacacagagacaaggctgtggcagaatgaaaacaaaacctccttaattagcaaattatagcacaggggctgataaaactctgtgttttgtagctgagctacccacttatcgctcctcccctctcatcatctgcacaagtgagagcacttctaatgtttatacttaaaacaaatgacaggggggaaaggtttctaataagaggctgagctgaagccccatttctaagaaaatagaatggctctagtgttttgtcagcattcttgctaatgccacaaccaacaggatgaaacaggcacatagcacagaagatcctgtagcccagacttgtttatccacaggctgctggtctgtattgttattcaggtgctttttttttcttttctgatatgtatctgctttaggaatatttccctgttcttgtgatgatgggcaggagaaagaaaagacatgaaattcccttgtttgtgtgcctctaaaatgtcacctcacagcatgtccagacacccagccaagaaatggcttagtcaggctctctgccaactggcatgaacctgaagattactgggcctcctggagggcgatctttttcccacacaacaaaccttacaatctaccttgcaatggtcccaatactaatactaattcctcttgcaatatagggcaggggtcagctaactttttctcaaaagggctggatattaagtattttaggctctgttgcaactcctcaattctgcttttgtagtatgaaagcagccatagacaacacataaatgaattagtgtggctctgttccaataaaactttatttacaaatgcacggacaacatataaaggaaggaaagtggttgttcttcaataaagctttatttacaaacagaggtggcaggaaggatttggcccaagggccatcgcttgttgacccttgatagagaggatggaaactcagaatattaataaaatttctgccattatgtagttaaaaaggtaatatgtaaaatatagttgcatcaaatttcacccatcaatttgattatagtccaaatctgctcatggacttcatttatttccctatttattaaaaaataataaatagagccaactatgctgtaagcattgtgctagaaaagtcaatctgctaccagaaatgattaaaaaaaaaagaagaagaaataaaaactagtgaacaagacaggtgcatcatgtacctcatagagcatagtgtctatgaaaatagagagtcgctcattctgcaaatatttattaaggttctaccatgtgtcatccactcttctaggtagaaggtatactgcatcaacgagatagacaaggatgctgctctaatggagtttgcattcttagtaggcggagatagaataaataatctgacagacaataagtaacacagcattatgcagtagcaagtaccatgaagaaataaaacagtataataaggtagaaagtctcttagtaaagtggggaaggtggtaggtaatggtgctcagagactttctgagaagactgctgagtgaagacctgaatgaagagaagtagccaaccatgcaaagatcagggggaagaattttctgagctgagtaaacagcttgtaaagtccctgaggcaggaatgagcctgtctgttggagaaataacaagaaggccaatgtcacttgagtgtctggaatgtcgtttgaaggtagtaaatgatggggccagtgagaggtgtggggcagatcatataagacctcctggtaagaattcagattttattcctatgtaatgagaagttgtaggaggattttaaggggggaaatgacattcttattcatttaaattacattaagccaatacctttatatgagaggagtgctattaaaagaaagctcaatgtgaaatggtacagtcaggggtaaggaagaactgtaattgcccatagaaactcatagaaaaggacctacttgtcatagccctaaaacctgagctctctcaatggagacagtttaccaaaaggctgttataacactaactgcctaacttctgggtctgaaagggttttttttggatcttttgattctaaaatgtaacaagcaaccaataataccgaactatttgttgaaaagttaatacagattctgaagggctcttacttggcttgaaaatcagaggtctattcttcaaatgaagttgatggggacatttctacaactcgatttaaaagatcattatttctattaatctttctcagcaactgttacttttcccaatctctaggcataaattgtgcatgtatcttattttcacgtttagtgacaaattattaaaatcatacttactaaatatctactttattttttttgagatggagtcccgctctgtcattcaggctggagtgcagtggtgcgatatcagctcactgcaacctccgcctcctgggttcaagccattctccttcctcagcctccctagtagctgggattacaggcacacaccaccaggcccagctaagtttttgtatttttagtagagacagggtttcgccatgttggccaggctggtctcgaactcttcacctcaggtgatctgcccgccttggcgtcccaaagtgctgggattacaggtgtgagccaccacgcccggccaatatgtacccatttcacacatttaggaagttcccacaaatgtgaaaataaaacataagagcattctctctgactgttgcacagccaccaccggccaccaaaacaataatataccagtgagaattaagttctcatgtgcacatattatacagatgtatattaatataattaagttctcatgtgcacatattatacagatgcatattattataattaagttctcatgtgcatatagtatacagatatatacatattatacagatgtatgcagtaaatggctccctactgtactgaacaagaaatactaagttcttgtgcttatagaagtacaaaacattattgtacaaaggaatatctagctgaccctcaagtagcctagtgctaacatttaagcagactttagcatcttaaagtagttacaaggtcccttaattttcactattttatagttaccactatacacttgagcacttgatttcttaaaaactgattattacaataacaaaaaattaatccagacccttaatgaacatgttcagaggtataaaaatggataagcgacatttactacacttgaggaactcacagtctaggtgggaaaacaagcctagaaacaaacaattaaaacaaccaccacaacaactttgaactacagcattaacatgatacagtcaatgtactgtgatgacatttgagaactcagcctgggagggtaagtggagtgtgggtagatttcctggagaaactggcaacagagctgacccttaaagaataattaagaagatgaattggagtgactagagaagtttttgagattctagattactggttaaatataatttgaataattaataaccacctactctggacccaatattgttttaactagtattaggacaaaaataaccataggttatagtccttgcctataggacaacttacaatctattgaagaggtaaggtgtatacctcgaataaaatgctgacagtagacagtaaagtgcagaatgcaatagataatgcattcattttttcatttaacacatatttattgcatatctgttataaatatgttatatactcttctgggaactgaggttatgacattggacaaacacacatggtcactggcctcatggaggtcacattctaatggatattaatagggattaatatatatgtaatatatgggtttaaaaaaatcgtcatcatcaatgtgttttgggtaatagcatttcaaatcttaactctgaagaaaagaatacaatatgcaaataggggacatccttaaccaaaaaatgttgtcaatagaaaaacagctaaatagtccagtaaaatctttgtatttcttaaaatattctggatggcaattcataactatattttccattaatagtcatcaattttagctagtgtaaaatatgtatagcaaatagactattgttttctgttacaaggcattattgactcaatttatttaaacttttaacaaaaaaagacatcatttggcaaaagcaaaacagatcttctaaggattccccaaatcttagaacattatacatatttaaatctaaatattttaaatgtacatctttgtgaactttttgagatgtgggagacagaaaacaatagttcacaaagtacaggatgtgggctaaatgtttcactgtcatagagaggtagggagagatcataagaaagtgacaaagacacagaggccagctgtatttatcattacttatctaagagctggtcactctcaggtatttactatgacttgctaataattccaaaaagagctgtattacagaagagatcaaaccagaaacacacccaggtgtttcacaaaataaaactatgatgttaggcatattattcacaccacccttcctggtctgagatgtcacaataatgctatcaacctacctcattttaatcgacaagtgattatggaaagttgatttctttgaattaaatccatcacatcaagaaagcagtgccataacagttccagtatttatggtgacccacaaatcatttgcccccttgcatgccttgcttctcatcctgttcagttgcaagaccagaaaagttgaggaaggaggtttcccttcatggaaggtgatggattaacataattatcatatagcttcatttagagttgataacacatctattctgcctcaaaacctttcctgatagcgatgccatgagctgcataataatcactatgctttgattaattattttgccaaataaatggataaattaatttcacctacatacactgatagcctcagtttctgcagggtgttgcttcttcctatggcaactacttggaatcaaaatagaagtaatacaaattgcagtactgagcataccaaatggttacagtaaaaagatttccatttcaattatcagaataaaaatatcacatgaagtttagaacttggagtgaagaaaactcctaattaagggaaacttatgaaagcctttagcaagttctttgctgaatgcattttttggtttcttgatcctccaaccaatcacattgacaatgacaaaagatatgcaaatttaaactgacaatagtcaagccacattgctctgactcataccaatagggacgttttcagcatatattcagcttgatttttacacttgaaagggtgaatgtaaccaaagaacattttaatagttattcttggctataatctgaaagctatcccataatcattgaccaagaacaatgcaaacaagaatcaaatttattttgcaaaataaattaacatatgaaacacgtgcatgatttaagcccagcagaattatgtgtttaccctgtcactgctgaataattgcatagcaacaagaaatatgcattactatgtttgaatcactattgtgattatacgctttaagcaaacaaaacattacgtttttggtagaatagatcattcaggataacttgggactaaattttccttcccgttccctcaaagaatccagactaatatgtaatgattgaattctcactaaaaactatacggatggtgtactgaagaataataacaagctgttcaaccaaaatcatttgtttacaatggaaataaattttaccaaagaaaaatacaaacatcctattataaactactactgaaagtaatgcataaaatttcagctacaattgtaaaaaacctgagagttctgtttgctttttattcttctgcctacctactgattgcctattacagtcctatagtctgtaatagaaagattacaatatcagctttggaaactgtagaactactaagttccagttaatgtgtcaaataaaataacagtgatcttagttcagtccctagtggacaaaagtagaataactattacttggcatgattcagcaggcaatgacctaagtgagtgtgaccacacaggaacaaaatagagcatttgtcctttccctatcttttatctttttaaagggattgcccggttaacagactaacttaaagaagcctgattgcatacctatctacatgtaccaagtgaatccattaacaagggagagaagcttttcacaaattgagacattgcctcccttctagtagcatagtcagttgaatatacttattctcggctgcctattattaaacagagtgcaaagacagaatgaattgcagaagtgtgttcataatttaataggcttatcttcaacaaaaacttaaatggtttgtagataaataactggataaactattcgatttgatttctataaattgagattacattcatactcaacattaacattcatcaaataacatggatacttaaactcgccaggtactgtctctaactacaatgccctgagaagggaggtatttcaggaatatagtagactacatgctgcgttcagcccatatctgcaggtgcatgtcttcctcaacagccagcatgccctcatcgtgagcgagcaacccctttccgacagttaacattacaatgtatctttttaattttttttctcaaggacagaagaaaaaaatatttaacagaaatcagtctactattctaccacttgctgaaactaacagttccctttacataaatatacaatttctccaaccaaatatcatattttatatttactctcacttcatgttaatttttataaaggttaaaaaaacaaatactttgtgatgatttgccaccccagcggcacaaaattttctggtgcaaaatcgatttgatcttattaattaatattgtcattattatttatttttcaccaacttgcttaagaggtacatactttctttcttaaggtagtgttttgacagagagaaccttaatgctgaactttagaaaagagaaaccaaaaatgtcataaaatttgccagggctagacacacaaacggggtgcccccacacattcataggtttgggcaagcccccaaaccttggcttacccaggaagccaaacccagacagccgtcttgcaattgcaaacactgcccccctggagcaaaaggtaaatacacaaatgctcccctaaggaactttaagttagctgcagtgcaagaaaggaaaaaggtccgtgctattagaaactgaaagcaatcacttactttttgcagccactgagtataattttccatcacatgttccagatgttgaagtttctgggaagagaaatccggttccacgtgtggagcatctctctgcagagcgtttgtgttgtactggtctgtcgtactctcacgacagttgccatcgtgttctggaagaatgaaagtgtaggcacattgcccatgttgaatccggttatatcttctcccactgttttctggacttcggcgctgattgctgcaccctatgtgagtcagaatggcagcgaggaaagcaaaggaaaggaaaactgtcattgtactgccagcacactccttccgtgcctctcgcaaaacttgctcctttcttctgacctctaaaactagttctttatttcaggtaaaactgcttgtttgtttgactctttccccctcaaagaaagcgtttgaagaagaatcatagaaaactagccatttgttagctttgttctaaaattttaaaattttttatttcactgcaatgatgtttttcttcgttaaaacttgagatatttattgcatagtagctgagatttattgtttcctctctgtgtgaccgttcagcatggagcctgcctgagtcagctgcgtgtacatattctagaccctttcctctaccctatctgctgcagatctgctattttctcccagacctcagtgagttttattaaggttgcacatccaagccaagctggaagcaggcagcctttcacaagatgacttgacaggaatgcatgagtgtgcccc

SEQ ID NO: 410 - DNA, 248545 bp, Homo sapiens; identical to SEQ ID NO: 409

SEQ ID NO: 411 - DNA, 238590 bp, Homo sapiens
ctgcgtgatgggacatcaggcagctttatttatttactcttaaaactgttacaacagaatcatggactgacacaggtaatggctgagccataagcaaatcgagaagtacagaaatgtcccaccccaaacagctgcggagtacacatcacacagggcctctggtcccggccttctcaggtgctctggagtggaggatcctttgagggaactctgaccactcctgttgtctacctagagagcacgccacttgggccacctacccccaacctttggccaaaggagtgaaaggacctggaacctgtcgtcaacctcagcatcctcatgaccccaggacagacgcagtggaggcagcaggtactctgggcctgtgctgttgcccctgaggtgtctcctgactacgcaaccctgtttccttcccactttcatcccagcaggccctttcttcctgctgacaaaacactggctccctcatgttcttggcacagcagaagtgttctgcacatggtctctacggaggaaagctggtccccctggcccaggcagcacttcctccgtgagcccctgcagtttcctggtgtgtgcttggggagctagggacatggtgtcaaacctccacaaggcactgctacctcagaaagggggaggacctgtcaggcccaggacagcctccctgcacatggagatcaaatctaaacttaggtcaagacccctaccttctccagggatgccaggaccagagaagggcagaggtcaggagggggcatgaggaggccaagtctggggcagcctcctcagaggcaaatctacactgcagccaatccccctccagagaagcccttggaatctcccaggccatttcactacaaacttatgtttgaatcctttattagaaaccatgcaaactttaatacaaaaaatacaagtgcaataagaatctttgtgtcaatacagttcccgggatttctcctcactgcagccatcccaaggcctagctgggatgccctctgtgggccttgcctctcctccctcccctctccagtcagggcataagggaagcagatagccttagtctcatgccttttatttttaaatttccagacctgatttcctactatctgcatgaggctcccttggacatgagggcttacatgtcctagggtgtgggtgccggcctgaaggaattccatctcctggccctttcttgttctccagccctggctttttatcctagggctgaccaccagatcccagggaatgggacagagatgccaaaaccagcctcttggttagaaaagaaaagcagcatacacacaacaaaatggcaaaaccaaccagtccacgctccaagggccccttgtgtgcctgaccggctcaccagccacagcctctgcacccctcttccctgccgcaccgcctccagggccctaagctgcccacatcctccagcgggggtggcataaggatatctccgccctgttccctctaacacttactgaggactttcatgtagacatggcttcaacctgcagaactattttgccagtttttaggttattagaaaaaaataaaaggacaaaacaagaaaaatgtgacagcagctaggcgggtatgttaagcatggggacaggcagcactgacccccaacttggggcagggcagcaagaagggcccgacaccacctgcatggggaggggggggcgcccatttgtgggaccagagggagaggcagtggcttaagctccacggtcagcgtcctgtcaccactcggaatccacctccactcttccctccaggtagatccagggagaagggagggcatgtcagtttcttttgggtttggaccaaagaaccaaaaaaagatgaggatagaatctggttctcctctcctagatcccaacttagcctcaaccaccccaaccccctcccaacctcctccacggagcagtggcgcagtgatggggcaagaccaaagcagggagatgggcccaggctggggagtgagaggaggtgtggggcagggctgctgctgccccgggcacgcaaagcaggagggaaggcgagcctagcgggctgcccagcacggcgcccaagcgctcactggtctagtggacagcccgggaaagggggccaaggacccgggagcccgagttggggccgccagggaagtgtggggggcgggagacaatgtcggccccgtggtcggtgcgggccctggcatttgcccggaacgtcagcctgtaggtctcaatctgcagtgacatgggaggagggaagggagaggggaacaggggagacaagaggggaacacgggggagacggaagacgagaccagaatgtcatcattagatgcctggaaaataaaaggttacttcattaaaatttaggccacactctagtcaaaaacaaaggagtttcaatttgcggccagtggcagggcccctggctggcccttaggccgagcccagccacttacttgtctcctggatctggctgtccaaggtctgggcctccctttggtcaccaccccctgacagggtggggtggccattgaggccactggctgaagtgggggcgccagcttcaggcgctgcctcagagatggccggctcctccccagcagggggacccggacacagaggagcctcgctgccaccgccctcagtctacaatgaaacagtgggggagacagtgcagggtcagtcgagggggggagtgggatggggtgatggtggtgggtttcacacacagcccccacccttgctgccctggcacccactggctcaaggcacagtcgcttggagaatcccaggcaggtgccccggccccacccaccccacctcacctgggagaccgactcccgagggtcaggagcagctggaccagtgacacactctcagagcccctctgtggcatgtgaggctctgatgaagcctctctgagggcagaggtgccaggcctcaggctggtaccaaagacgtagccatgacaacagtaagcaataagcctgaagggtagccccctgaagggtacagcccaccctcccaaaccctccctgaacccaggccaccccctgcacacagagtggggtcctcagtagctcccgggcagccctgcctgcacatctgtctggtcaggaacacaggtgctgaggccttgtctgtgcggggcaccattctgggaccaggggtccatgggaggcagaaaggtgtccaaggaggtataacccagggacactgtggaggcctggagggcgtcataggaggaggacatttgggggacatggaacactcagtgtgaggaaggcagagaagagagaacagctgcgagaggccactggggagctggaaagcgtgtgtcgccaaatacccaaaaagtgacaagggagaagtggtttctaatcggcatagtgagaaataggcctcgattaaaaacaataattccagaactaataaagggatataatgtgaacaaggaaaagaacacaaggcttagggtcagaaaagcccagatgtgaatcctggtccacgctcgctcgctgtgtccttggaaaagagactaaagccaagttaacgccccactgagacgggcgtgagaacggcatcctcacgaggtatggggggcacgaactgagagcctgtggcagcaaggacccccccagatgttcctggaagctgatcaaggcttcagtcagagcatcaggagaggatgggacaggggacgggctgggcagtggctggcactggggagcagagatggaagggaaggcccagggcagcggctcctggcccctctcccctgcgcacctgaacccgagcagcagcagccatccttgtgctcggggtctgcaagatgcccctcatgggccccccacccacggatgacatggaacataggacagacagcatcttggcacacaaaaggtctcacagtactgtggaaggaggaagggaggaaagaggagagagggaagggagaagaggcccagccagtcgtgaggatgggaacctctgccacttgagctctgtcccagagccctgcagagggaggccccaggcaggccctgcagagggaggccccaggcaggccctgcagagggaggccccaggcagcctgctgtcgctggcagctaagaatgtgctgtcctgctcctaacccaggagcggagcctgacatggggcgggaacccacattccccttggcgcgagacagctggggagaactgtgtggtgcagaacccccgctcgcctgggggtggtctgtgtcccagtccgtggccttctcaaatggctggatgggctcaattaggaaggccatggctctcaggagcaaggttctgcctccagctgacaggtgaggggtggctgggctggggcctcttcacttctgcctcagtcaggactgatgatacacggtgggaaaacggcaatggtgtgggtgaagacatgactcctgaagagactgaggggcggtgacaggtgcctacctgtgaggaccctgaccctaactgcatagttcccacccctccccagctgtgtctccccagtgacccactcgctaccttcacagcacctcctgcaggtaggtggcccacattatcgagggatcccaccttggcctgggccttctccttgaagttcaacttctgactttcaatcttgacatctcctccacctggaaccacaaaggaactggtcacctagggtggcagaggaatatccctgcaggcaaaaccaggactagcgatatgcccaatctagaaatgagacagacgtgacctgttctgggtggcaaatgaagaacagtgaacacgtttgtctaaagaggacttctcatatcacagtgaggctgagacaatctctccgtccagccagtgggaatacctccaagaaaaggaaagccatcccttccaccaccccatgccacagccactgagctgcaggccaggcttgggcaggcctggggctccgagcacagcctccagggcgaagcctctgcttctctactctgtgtgggaatgccctcccgctaactgggccatgcagtgcttctcaggcacagcctcactgaattctcatgaatgccctgtcatcacggccacggtccctgcttcccagccggtaaaactgatgctgcaaaagagaagggactcacccagagttaccaccaatctgctgattgacagtgacaggttgtgaaaattgtctgagaccctaaaccgtaccacactctagcaaaaagaaggaataataaaaaggacagagtggccccgaggctgtgcgctgaggaaggaaagacatggaccaaggcaggcctgggatctagtgacctcaggctaggacggggagggaaagtggtctgaactcacgcccagggttcagagctcactggccagagtgtgcccatgagaccaaggggaagggtgcgggacgagctgccctcaatgagtacccagcccctcccgcgcccagcagcgtggtttcccttgggccccttctcctgttcttccatctcctctcagctcacatggcagacctccacgcacagcttctggccgaggtctcccggtgtcccatattgggaaacccagccctggcaaaaactagaccctaagtgactcagtgtcattagagaaggaagtatctgataggagatttcccagataaaaggggaaaaaaatggttagttaaggacagaactgttttgatctttctaaatagaacacattctaaactggatcatgctcttcgctgagagggaaagggagttttttttttttctttttggagacagaatttcgctctgttgctcaggctggagtgcagtgccatactctcgcctcactgtagtctctgcctcctgggttcaagcaattctccaaaggcatgcaccaccacacctagctagtttttgtatttttagtagagacagggtttcaccatgttggccaggctgttctcaaactcctgacctcaagtgatccgcccgctttggcctcccaaagtgctgggattacaggcatgagacaccgcgcccgccctgagggaagagagttttgccttcaccttatctggcctgtggtggctagccttctgggataccaggtctgccagccagtgtgcctgctgctacagcagtcctactcacaaatctgctgtagacccaggaactaggacacgaggctgctaggggactacccaaggcaagagcccagcctccgcacagcgacttccacaggggcgctgggccaaccatgttgctggaaggaaactgcattagtgcaagttgctgaacgcctcccattctcctgccagggctagcggctgatgcttcactggttgggagcaccctttgctcctgcatctgataggtgggacctgaacactgccctctatacagctccttcagcagtagcttctgtaatcctcgtttagagccaatccaggttctcagctcagagtgcaccacttccccaggcctagctcaatagttccacacacacagtaggtactcaagagaatgcctgtgcagatggctgctgtaagaaactgctcctcctccacttagaggttagcacccgaactcctgctccctgacagaatgaggactgtggtgtcctgggtagtcttcatgggatgctaaaggcacagagatgaaacccttgccagccagctggctgcccagctgacccatggcaggacgacataccctggagacccagtgggcaagggaggcaccactcaccaggcttgtgcttgatgttagccttagacccacacttggaggagaccttagagatgtccactttcttgttctgaatctgaacctgaagagaaggacacaaaagactcattcagagagaaggtatactgtcagagccaaccccatgctaccttttaaatcttctccatgttcagggtttctcgctccctctgtaagctgctatctcagtctggtcaaagacaaggtcatctccctaagtacttaaaagagccctcgacccaccctggccctgctcttcacttccttttttttttttaaagatggagtctcgctctgttgcccaggctggagtacagtggtacgatctcagctcgctataacctccgcctcctggggtcaagcaattctcctgcctcagcctcccgagtagctgggattacaggcgtgtaccaccacatctggctaattttttgtatttttagtagagacaaggtttcaccatgttggccaggctggtctcgaactcctgacctcaggagatccacccacctcagatttccagagcccagagtgttgggattacaggcgtgagccaccacgcctggccttcactttttttttttttttttttaagacagagtttcactcttgttgcccaggctggcacgatcttggctcaccccagcctccatctcccgggttcaagtgattcttctgcctcagcctctggagtagctaggattacaggcatgcgccaccacgcccagctaattttgtatttttagtagagacagggtttctccatattggtcaggctggtctcgaactcctgacctcaggtgatccgcctgcctcaggatcccaaagtgctggaattacaggtgtgagccaccacgcccggccaccagccttcacttctaaccccacctccagccagaccaaaccaccatttccacaccccacaggtctttctgtgcagaccctgtccatgcatgctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggagaggtgagggggtggtgtgtgtgtgtgtgtgtgtgtgtgtgtgcgcgttgtgtgtgtgtgtgtgtgtgtgtgtaatcatagtattcctgcttaatccatgttataacaattttcccagccaggtgcagtgggtcatgcctgtaatcccagcactttgggaggctgaggcaggcagatcacctgtggctaggagtttgagaccagcctggccagcacagtgaaactctatctctactaaaaatgcaaaaatttgcatttaaaggtggtgcaccttggctgggcacggtggctcacgcctgtaatcccagcactttgggaggctaaggcgggcggatcacgaggtcaggagatcgagaccatcctggctaacatggtgaaaccccgtctctactaaaaatacaaaaaaaattagccgggcgtggtggcaggtgcctgtagtcccagtactcgggaggctgaggcaggagaatggcatgaactcgggaggcagagcttgcagtgagccgagatcgtgccactgcactccagcctgggcaacagaaagagactccgcctcaaaaaaaaaaggtggtgcatctttaagtctatagccatgcatgccctctgggttgctggatggggattccagcattcctgtgagcggccccgctgtcctctggtaggtactgtgggagagcctgactttccaacacatcaactccatgcagtgttgcaccattctggtgggtttcaccacaagctgttaaatggtgagctaccttcttgagccctgttttcccttctttggtgtcaggaaatatagtcttcaccatgtttccagaggacagatataatgccaccagtatttttgtatttgcacccacagcccaaggcctggcacagaataactacccacaatccccagcttgccagagccattctcaatctttcctctaaaacttggctcatgcctaacccagcaaacccattatgttttcttccccatccttcaatgcccagctcaaaaggtgccttccatacggcctcacatagctctcgcttcaatccgtctctttctcatatcatctcttgaagggacaccaccaggaactataccataatggcttcacgtgtttgataattacatacagagtagttactactgtgaaaacacacagcctctactttgtctcatctttccaaaaagtctgcaattttccctagatagaaatttttttcttttctcctcaatctatagttcattatacagatatttataggcatctccaaaatggaagtttaggatacagcacagatacctcctcctaagtatgtgctgatgacaccactgtaagtgctttatctgggtttaaaacaaggtatcttgttatttgttaggggaagaaatggccaattcaagaagagggagacatgaagacctcatccaaacatctccctatccttatcccccataagagagggcatagggaagggtacttttaccagccaaagatctggtagctgcttaaaccaacccaacatgggtcttcaagcaatggtgacaagctcatcttagctgtaaccacaacagcacctgcaagaagttaacagtcactctccaagcccagggccctcaccaagatgtagagccacagatttctttcttgttttcttttgagacagggtctcactctgccacccaggatgaagtgcagaggcatgaccttagctcactgtagcctcaacctcccaggctcaagcccctcaagtggctgagactacaggcgcacaccaccatgcccagctaatttttgcatttttttgtagagaaggggtttcgccaagtggcccaggctggtctcgaatttctgggctgaagcaacccacttgccttggcctcccaaagtgcttggattacaagtgtgagccactgcatcggccagggccacagatttctagacagtgttccatatttgaagcctctatctcttgaccttttgtctagtatgcaattaaagaatagttgaggggcagtcagtttcacattatggatgtattccagctggtaaatgaagaagtaatgctagaattagtcttaccacggcatatgcctactgaacccacaggtccaggaattgccaacatcacaaaaaaagagacaaccgaagaatgagacatgaatgtaatttctcacagaataaacctcattacctacttacatgtcatgctagcatgtggggaaaaaaccaaaaccaaataaatttaaagaaaattgagggacaacagaatatgttaattaaaaccatgaggatgtaattagaagaatccagattctaggacaaaccactgagcttacccatcaaggaaattaccagtaaaaaaaagaatgagccaggcacagtggctcacacctgtaatcccagcactttgggagggctgacgcgggtggatcatttgaggtcaggagttcgagaacagcctggccaacacagtgagaccctgtctctactaaaaaatacaaaagttaggctgggcgcagtggctcatgcctgtaatcccagcactttgggaggctgaggtgggtggatcacctgaggtcaggagttcaagaccagcctgaccaatatggtaaaaccccatctctacaaaaaatacaaaaattagctgggtgtggtggtgggcactgtagtcccagttactcgggaggctgagacagaattcttgaacccaggaggcagaggctgcaatgagccgagatcgtgccattgcactccaccctgggtgacaaaacgagactccgtcttttttttttttttttttgagaccaaatctcactttgtcgccaggctggagtccaatggcatgatttcaactcactgcaacctccgactgcctggttcaagcgattctcctgcctcagctttccaagtagctgggattataggcacgcaccaccacgcccagctgatttttgtatttttagtagagccggggtttcactgtgttggccaggatggtctagaactcctgaccttgtgacccacctgcctcagcctcccaaagtgctgggattacaggtgtgagccaccacgcccagccaagactctgtctttaaaacaacaacaacaacaacaacaacaagaacaagaacccaaaagttagcagggcatggtggtgcacgcctgtaatcctggctactcaggaggctgaggcaggagaattgattgagcccagaaggcggaggttgcagtgagccaaaatcacgccactgcactccagcctgggccacagagtgagactttgtctcaaaaacaaaacaaaacaaaacaaaaaaagctgctggctcacacctgtaatcctagcactttgggaggccgaggtgggtggatcacaaggtcaggagatcgagaccatcctggctaacacggtgaaaccccatctctgctaaaaatacaaaaaattagccgggcgtggcggcgggtgcctgtagtcccagctactcaggaggctgagacaggagaatcacttgaattcgggaggcggaggtttcagtgagccgagatcgcgccactgcactccagtctgggtgacagagcgagactctgtctccaaaaaaaaaaaaaaaaaaacctaggtagcccacaccatgaaacagatgtagtttctgacataagagtcctatgttaggaatatatcctagagaaataacttgaaatgttaaagctatttatacaaaaatatgattttaaatgtgttatagtttcatgcctgagggacagagcgagactgtgtctcaaaaaaaaaaaaaaaaaaaaaaaaaaaaagaatggagtggggacttgtagagtaaaaacagcttaagattaaaagagttatagcttgtattatcttattagtgttactattttaaatatatggatcaattttttccttttttttttgttgagacggagtctcgctctgtcacccaggctggagtgcagtggcgtgatcttgcctcactgcaacctctgcctcccgggttcaagtgattctcctgcgtcagcctcctgagtagctggtactacaggcacgtgccaccacgcccagctgattttttgtatttttagtagagatggggtttcaccgtgttagccaggatggtctcgatctcctgacctcatgatccgcctgcctcagcctcccaaattgctgggattacaggtgtgagccaccgcgcccagctatatgctgaagtattaacaaataaataatatatctaggactggcttcaaaatacttgggataggcatatacagataaaccaagactgctcatgtagatagtaaatgaggcagggtaaaaggtacatcaggttcattttactgtttttttctacttgtctgtgtttgaaaattcccacaataaaaagttgttttttttttttttggtttttgttttttgagacggagtttcgctcttgttgcccaggctggagtgcaatggcacaatctcggctcaccataacctccgcctcccaggatcaagcgattctcttgcttcagcctccagagtagctgggattataggcatgcaccactaggcctggctaattttgtacttttaatagagacggggtttctccatgttggtcaggctggtcttgaactcccgacctcaggtgatctgcctgccttggcttcccacagtgctgggattacaggcatgagccgctgtgcccagcccagtaaaaagttttaaaaagcttaactgagcctcactcactttaataaagtccaccacctctaggctacagctctccctccttaggtggctatgtggaggagtctacaatctgcttccaaacgattcccccacaccaccctgcctccactctatgctccagcctcagggaaccatgtgcggcgcctccttcatgggctggcccaagtgtcccctcctcggggactgcagaagccacgctggctctctgtggtcctaggagcaatcacggcatcacacaccttgctctgcttgtgcttacacaggctgcctgccgctctatgagagcctgcaggcacactccaggtaccaaaacatgctgtcagcaggtctcagtgcccactacacatgcacagccccttgcaagggtgaaatggaaccaaaacggacacaaaatcttaactgggaccagccacagaagaagccactacattggcactggctcatcactcccctccctcccctccgctggtgtcctcctggctctcatcaaggggtatgtctgtctgtctgtcgggggcatttttggagcactaactaggatcctgtttggagcctctcatccctgtggtaactgcgttatttctgtgtgtgtgtgtgtgggtgtgggtgtgtgtgtgtgtgtggggagtggtggggggtgtaatgctgttctgtctgcacagcaggtcctcctcccttttttttcagtgtctctctctgtcacccaggctgaagtgtggtggtgccatcacggctcattgcagtctcaactacccaggctcaaggaatcctcccctctcagcctcctgagaagctggaaccacaggcacatgccacctaatgctgccaggcacatgtctaatttaaaattgctttgaaacccaggctggtttcgaagcaatcctcctgcctgggcctcccagggccactgtacctggccttattttaaaagatattttttttgggactgggcgcagtagctcttgctataatcccagcactttgggaggccaaggtgggtggatcacctgaggtcaggagttcgagaccagcctgcccaatatagcaaaaccccgtctctactaaaagtacaaaaattagcccaggtgcggtggctcatgcctgtaatcccagcactttgggaggccgaggcgggcggatcatgaggtcaggagatggagaccattctggctaacatggtgaaaccccgtctctactaaaaaatataaaaaattagctgggcattgtggcgggcgcctgtagtcccagctactcgggaggctgaagcaggagaatagcatcaatccgggaggcggagcttgcagtgagccgagatcgcaccactgcactccagccttggtgacagatcgagactccgtctcaaaaataaaataataacataacataacataaaatacaaaaattagctaggcatggtggcaggtgcctgtaatcccagctactcgggaagctgacgaaggagaatcgcttgaacctgggaggcagaggttgcagtgagccgagattacgccactgcactccaggctgggcgacagagcaagacttttttttgtagagacgggggtcttactatggtgcccagctggggggctcatcattttaaactgcacatttccttgtggtggctttagggagggactgacagagattatggaaggaaacaaagcacctgggtccagctgtggtcagctgttgtttatcctcatcttcccaccaggaaagatggctcacagtagtctccctaattctctgtttaaggaagcctcctaaagtgaaaaggctttaaaaatacattcaccctcaaaacaacaaaacaaaacaaaaaaccctacacatgtgaggtcatgtgtaggcagtgtggaaagatcacagcaggtgatacattaatgatgactattttcagagctcttatatgcaccacacaacacacacaaatatatctctatgtctcacctacacaagtgacccagttccctcagaacccctgttcaccttctgttttcatccaggacaaagccaggctcagcagctgcctgggcccctcgtgggctggatctttgtcacctcacttcagctgatcctattccaggctgactaattagtctggtcaagcaattccacccgagtgtaaaggatgccatttctacccaggccaggaagaggcagtggtgagaagatgaccaggaaggaggggcaggaaggagttgtgtggggcaagaatgaaagctcatggccgcattcctcatgatacaactgctgggggtatctgtaggccatgggcaggatgtcatgatcaccaaggaggaggcaggagtgttaacagagtctaaaaatgataagggtaagtggagcaggacctagtccggttcaggacagtaaggagaaagaaccgaatgaactcaaaagaaacggaggcaagacaggctgtctcacttggcctggaagggagcggtgagggcaggggctgtacatggcggcttctggtgcctctggcacaactccacagagtaccacttttctaggcactgtcacagtgacaagcggaaagcacacagggtgttcttcacacactcgacgatagtaagacttcgccctgtctctccctagaccagaacctccctgtgagctgggatcacctgtgtccctaatacacatcatagagctggcacacaatggcagcaagacaaaaagaaggatgtttgggtggaagaggaaagaggacaaaaagataaggagggaaagtctgggcgcagtggctcacacctgtaatcccagcactttgggaggccaaggcgggcagatcacaaggtcaggagttcaaggccagcctggccagcatgatgaaaccccgtctctactaaaaatacaaaaattagctgggcgtggtggcgcatgcctgtagccccagctacttgggaggctgaggcaggagaattgactgaccctggtaggtggaggttgcagtgagctgagatcacaccactgcacgccagcctgggcaacagagtgaactctgtatcaaaacaaaaacaaaacaaacaaacaaacaaacaaacaaacaaaaaaacaggaaaagggactaaaaaaggaggggaagaaaaaggaggaagggattagaaaatggacaaaaaaaaggagagcagaaagggaaatgggagggccgggcgcagtgtttcatgcctgtaatcccagcactttggcaggccaaagtgggtggatcatgaggtcaggagttcaagaccagcctggccaacatagtgaaatcccgtctctactaaaaatacaaaaattagccgggcatggtggcgagtacctgcagtcccggctactcgggaggctgaggcaggagaatagcttgaacctgggaggtggtggttgcagtgagctgagatcacaccactgcactctagcttgggcaacaaagtgagacttcatctcaaaaaaacgtggggaagggataggaagaaaatgttgattaattcttattttataataacaaggattcaaagatgagctctggaaagatccatccagacatctgtctcagagaagttacttccacggtaattcaagggcatgcagaccgacatacacatcccaggaacggactccagacaggcaacaggtctgctgctgaccactgtgctcagacccaggctctgacatagctggagaaaaatccaaagcctcccacccatatgggtaaaaagatactgagtggatatcaccatgctggtgtttaggggctcaccagaaacaccctgtctaacatgggagcatcaaggtcccctcactttgctagtctgcttcttacagaacgctacagctcaggtcactgggattctatctacatgggcacctggctctctccctagtataccccacagtgggctatatctcagatgccagctaaccagagcttatacttacattaccacctccagggacatgcttaatattgtccttggaaccacacttggactgaatatggctgtagctcacttttttggagactatctggacctggagtgttagaaaatagaaaaaacaacacaaagggagaggactggttagaaccgacacagggaaggcagtgagtccacacgtgatcacaatgaccaacaaaaagtgttgttaaacctccacccccaccttctacagaacagatgtggaaaagcacaggaaaagaaatgtgaaagagcaagaaggggagtgaaaaacgtgaacagacaacacaacgacaggagcagagctgcgcaggcactgcatgttggtcatcaccgctcctttgggggcggggttgtggttcacaaggcccaggcagcagcctaacctgatgcccaaccaggcacagccctacctccttgctctgctccctcctcaagagctgggcacagtgtccttggctcttctctgcaagtcttatcatgtggacctgttctcacccaaagagggtgcttcccttaaatctgggccctggaatggctgcagccagacccactctcagaagcaaaggctgctctgagaagcactgggcagctggcaacaagggcacggatgatactaacaggaaggaggggccagtgctcagatgtgcatacaaatggatacagaatctccaacaccaggggagcggctacagcctccacacttagcccatttgtctcagggctcgagaaggcatagtatttttgactcaagggtaaaataccttcttgaatcctccatatgcctaatcctctgccctgtgagatgcccatgcggaaagaacaggctctaagcagggcagcaaggacgcccaatcctgggggcacaaccacactgtatagtacgggaatggcttcccctggaactgagaaacaccaaggccctggctctaagagtctggaacaaagaatcctaggaccttctcaagaaggaatagttgccaacttcctttctttgcaaatgatgcaggtcccaggctgaagagttctccacagagtacagaaatcctgagaaactccaacccatatacctcattgtacctactcatttctagcctttttcacaactttgatggtaaccaagtggttagcaaactacttaatgagccttggtctgaacctaggacctctagtagtcacccagaagccacggtgcagctttcttcactgtaggaatgccctaggctgagacttcccatgctggtccctaagggctggagtgcgggcttctctggcagaggcacacctacctgctacagctaaggaaggtaggtgttgcaagcactcaggaggggcctggtttccaggtttacagaggcaaggggaaagaacctgtggtttcagcttacctctgccctccagttgatgctgcatacctatactaagtgggtttccattgggaatgagcatcctaactttcagttaagaggtgacccggggaaccaggacaaatgaagttatctccatacccagcagcgttatgagagggatcttctacttcaaggtaaagcacaggggctccagggttccaggtggtggaaattacccctgccatgtcttcttgataacgaatgtgggtgcactgtatttgcatccataccaggtaggtttcacatcaaggtcagtgtgaaggaaatgaatgaaagtctttggatccattttatccagccaaaaattatacacatatgtattctccaaagggctaatgggctcccaactctattaactttcaaggttaatacaaaaaattttctgatggccgagtcatcaagcacagagaagggaatataggggagaagaagtagaaactagttagggaaagggaaaaagtgcaagagagggcatgtggctcaggctggaagaagtattttaccatcttcaccttgcagaggtgggtctaaataaaactcactttccccgcaggttgtttctgtgcacttgcaattgggccggctgttttagtgactgcattagattcaggctttcgggttgtagcagctgcctctgtttttttctctactttggcctggatggagataaagggagggcaaatttcaaaccaagaggataagagctcaaaagccaagaagggaagaaggctgtaggggactcaaatccaggtcaggccaccaggcaaaagcaggtggcctttgatcctaggcaaaaccatacatttcccagggtagaccaagtcaaagatccttgagtagaggaccacaaaagaaggagctgcaggccatagtcttaagacatgaggaacagatcaagacactagctaatgaagaaaaggcacaaaggaaggctaagacaaccaaattagtgattctgagagtgtgctggggcatgattttccaattacaataccccccaccccatgccaaatgtcctgatatgccccaagcagctgccacggtcacaggaagtcaatactgatagaaagtgtcagactctttaggtatgttgaagcagaaaacaattcactagatcaagtcactcaactccccacccaagaactcctgtaacttttgcaccatgaaaccataagagcaaagacggggagataggccatcagcagcacagcccagaggcctgctgggcacaccagagccactgtcgctaccacaagcaactctcaggctcttctctagactgatctcagcttgccatcagtgtcttccaacagcaccaggattccacctcatttttgtccctcctgaatttcttaacagctccagattaagcaatttaagtatgctgccctggatggtggtggtggtgtagagctagtgaatgacctaggagatgagatggtcactactccagggacccgaacattctcagacggactttcatcaccaccttttcacgcagagttcccatggttaccaacagttaaataattctgggactgatgcaaccagaaaatcttaaccaccggaaaatcctaaaagtgaagcactgtgatctttctccatcactatatgcagtgcagtcctgctgtttaggaaggccagaggctcacagcacgactcatcctggccataagaggacaccctagtcctctttcagatatattccactcaagtcatgggttgtggaagtaagaggtgttctaccttctgcctatcctgacattctctgtgcaggctaagaaccatgaaaaactaggctcatgtcaagtgtctctctcacttgcagagtctctgaggcctcctctgtttcttctacaaaagaatccttttacatccaagcaaaaatgtaaactcagaccccaacatctagaacaggagcctttcttactgagacaggaagagaaagcccagagctcagcctaccccgcctccctgctgctggggcacaaaacccactacagagccccggctgaaataccctgatgctgagtccagtgtcctgactgcctgcttctttggtgggcctgggaacagtgggtggaaatggaggggaagatgcaggggccagcatgccaggaccccaagctccctggacccacccggcctcctccaggctgatgcttgatgttttccgtggagccaaccttggagcggacattcttcagatcaggagcagaagtattggtggccaggcggctgagccggggggtggtggagctgggtttggccgaggtgggcttcttgtctatgaaaggagttgtggagggccgggagggcatgggtgtggccttgactcggctgggaaccacccctgcagcgggggctgtcccactgagagtggtggttttcttcatggaactggtggaggtgctctttgggcgactcaagtcagctgcaaagaagggagtgagagataacacgggttcagggagagagagaaaaagggagacttaagccacagaggaggtgggggttcaagttagggctctacaaaatggcggatgggctattacctggtacagactttgcagtcatcttcttgacttctgcaggttttccctcagtcttaatggctgtacaaaatatacttattaatataacatttaacaaactgacctgttggatagttcatccaatagtgagattcctcattatttaacaattactgaatatctactttgagccagggactgtgttagtccctgggaatggagtggtaaattagatggtcaggcactgagtcttattcttctctactgccctgataagccttctatgtggccttaaaagtaggctgtcaatacatgcctatggacttgaatagccctcttcttatcatcatgtaagcccatgagcaccacgccctcttcttatcatcatgtaagcccatgagcaccacgtgctaggtgctgtgggttactaaggcaagagtaaattctacctggaaattcatgagcagtacatttttctgccttcactcaagatttttctgaatacatacaactgctaagctcacacagagatcaaggcttgttaagtaccaggcccacagggctaccactgttccaggtagtccactaaggaccggtgcgtaagcaggcctgcacagctgtttgtgatactagctagagctatggctggggcaaagccaagatcccattttcccctccctagttcccatgggagagaaaggcaatactcaccagtgggcttcttgggcaggagcgtggaggggctcctactgcttgggccagttgaggcaacagcagcagctgttgtggtttttgcaacagtctgagtgctcttggacccagatctggaggctggggcagaagctggcttggatggtgaggcccgcttctcaggagcctttgcatctgcaatgggctggaaataggaaagtgggaatgaggcctgcaggtcagcaatagccccaaggagtcacgctacaagatgcttctttttttgtttgttttgttttgtttttggagacgaagtctcactctgttgcccaggctggagtgcagtggcatgatctcggctcactgcagcctccgcctcccaggttcaagcaattctcctgactcagcctccagagtagctgggactacaggcacgtgccaccacgcccagctaattttttgtatttttagtagagacagggtttcaccgtgttagccaggatgatctcgatctcctgacctcatgatccgcctgcctcagcctcccaaagtgctgggattacaggcatgagccactgcacctggacacaagatgtgtctatacaaccatgtattggagaacaggaggtactgtgggttcagcagctactgacaggaaaatacatatggttctaagagcaaagtcctccacataaagcaacaaactggccatgcagggtgctatgtgatctgagggcacacaacagagagtaaaactacttcaatccaacttgagccagtgagaatgaacagccctgatgggtacatcaccacaacctacgtttgcctccaaatctactgctatatatatcatacacacacacacacgcatatattttaatgtaacctctgtagaaatgccaaaaatactaatgtatttaatgtaataaaatctaatgtattatacttgaccaaagattaaacatacacaaacaaaaactaaaaattatgttcaaatcgagccattcttttggctaacacgcacctagagaatgctgaacaggactgagctgcagatggagaggccactggccaaatctgggacagaagcgtgagctgtagccctactccagcaaatcactgagcctctgagctttatttcctcatcgggataaagagattagaatggagggtgatgaaggaccagctttgataatatgtgatgtcaggaaataaaggatgaaaggtctcagcacagagacgatgagaagaggcaggcctgatcaacagaagggataaaaagcactgatatcacagctacagtctgaaagcaaaagggaaaaagtctctcaagtatagatgcttggcatctgggtcactctagttccttttacatggaggctgagaatgacgtctctagtgaataagggaaagaatcagtttagcctggtttctacggggataggggatgaagacactattttgataaacaaattaccacattacaaaagagagtatgccaaatcacagacacagtgggctcagctctcttcctccaagagaagtggctataaagagggcagtatgtaggtagcgacaagcaggatatcgttaaatggaaaaatcagctaaggaggtactagaaattaagggctggcatccaaagtctaactctgcaaatgtagggtaatgacaatttccacaaataaaggccttaagtatggtgtgaagaacgctaaggctggaatcagggaaagtggttctgctaccagctctgctggaaacatgtaggattttggccagaggattcccttttctattgctctaaaatttgaggactaaaccagatgctctctgggatgtgcatcaaatttttaagactatgactattattcagaataatctagcatagtcttattattttgccatgagggtaataatgataaaataagttagaaaaaagttatgtgggatagaaatctcaaaaggatgttgcatcttttagatgtcaggctcttggcttcaaaaacctgcagaagttaactggagctattctgctgtttcccaatttacattttcttctctgccagaatcgtaatctacttattttttctgaataggtttttctctctctgtctctacaaatctttctaccaaaataagctgcagatgaagaggccactggccaaatctgggtcagaagcctgagctgcagtcctggtttggccccttaattctaagtgtgctatttggcaaatcgctgggcctctctgagctttatttcctcatctggataaaagagattagaacaggactggcgcggtggctcatgcctgtaatcccagcactttgggaggccgaggcaggcggatcacctgaggtcaggagttcgagaccagcctggccaatgtggtgaatccccagctctactaaaaatacaaaaaattagccaggcgtggtggcgggtgcctgtaatcccagctactcgggaggctgaggcacaagagatgcttgaacctgggaggtggaggttgcaatgagcccagattgtgccactgcactccagcctgggtgacagagcgaggctccatctcaaaaaaataaaaattaaaaaaaagttcatgtatatacagcaactagtacactacacttcatttatatgattattatagagtgaaatttcactagacacctctccttcctactctcctctgtcaccccccagaagccgctgctgaataagcaacagggaggacctgctgccagggctccaggcacctcccctctgccctcttattcaaacctattgttttctaaagatcaagaaaagcaaccaactggataaatgaggatcagagagaaagctttacaagattttatcattactagtttatgagaggatttttcagtttcttggccagggcttcagcctagacttcaactcctaggttccacagttttcttcaccatattaaattaaaaactgacattttaacatgggaaactatttcgtaccatgaatttaaagagtactatcaggctgacctaaaggcccttctcaaataacacaagatgttaaggaatgcagccacagcctccactatcctctcctcctggagcaattctgtaacactaatgctgctccaaatgtgaccagtttctgggcaatacagaaaccgtgggtgacctggaaaactggatgacttcagaagtagctcagtgagaggtggcctaatgcccaaagcaaagtaagttatcacatcatgctggaacatgctgagataagctggaagaactagttatatcacaatagtaatggataaaacttctgcaggatgataacagggaaagacaaagaattacatttgatgtgggaattataccaaaaaagaatatctaactggtatgtggagtagaggaaactggttaataagtgcttaaataggtaaagagtaggtagctgagagaaaggaggaagaacctaagtagatagagtattacctccaaacagggaagggaaaggtaagagcataaaagggcttcaaaatgttaatgtctgcatcaatgggccccaaattgatttccttttcttttttctttttttggctgctcctcgtggagcagggctaacccataggcagcgcgtccagagtagccatgccaattttcaaatcaccctctcccccatttcccttgccttttcccaattccaccagcctgattctgttgtctgttagcaacaaggatctgtctatctgacactcagaggggaacaattttcctcggcacagtagttaggtgaccacttacctttggcttcacgtcttttgaaggtaagatggaaggcctggcagaggcgacggcagggcgtttgggtggggcagctggcactaagcctgaagcaaggctcatgggttttttattcaacccaccaatggtggtgggagctggctgcttagggagagaagtgggctgtgttttggctttcgatgttgaagtctttgcaggttgagtggtggccaaaggctttaggttgattgttgtttattttttatttttattttttaaagggcaacatcaaacagacaagaataaaaacaaattaaaaaaagtataaattgcacaattcaaagtaaaattataagcaatgaggatagatgcaacttaaaattagcatttctttcttctgagctcaataaataatggaatgaaaccaggatagagaaagaaaatggggaatagtttctttttctttttctttctttttttttttttttgagatggagtctctctctgtcgcccaggctggagtgcagtggcgatctcggctcactgcaagctctgcctcccaggttcaagcgattctcctgcctcagcctcccaagtagctgggactaccagcgtgtgccaccacacccagctaattttttgtatttttaataaagacggggtttcaccgttttagccaggatggcctcgatctcctgaccttgtgatctgcccgcctcggcctcccaaggtgctgggattacaggcgtgagccaccgcgcctggcctgggaatagtttcttaatgatagtggcacaaattctggcagtttggcacctgaagatttaattcagtaaaacaattaactcttaataattaactaacttttggtggctattctaaaagaaaagcatcaggaggtgattcagccattattacctgtattttttttaataactttttaattttttgaagaccctggacaacatgctgaaactacctgtatcttgatgggacaatagcagccacagcctacagtgtggcttttgaactttgcaataagtactagttatgcatctgaagctatatgatccaccttcaaaatctgcattctcttttcatgaatggatatttcagaatctttttttttctttcatctaacgctgagataatagtaaataattcagaatttatttcagaatatttttgcaattgtcctttttgttgttgttaagggaagttgaaacaatctctacagaacttttttttttttttttgagatggagcccagtgcagtggcatgatctcggctcaccgcaacctccaactccttggttcaagcaatcctcctgcctcagcctcctgagtagctgggattacaggcatgcatcaccacgcccagttaattttagtatttttagtagagatgggatttcaccatgttggtcaggatggtctccatctcctgatgtgatccgcccgccttggcctcccaaagtgctgagattacaggcatgagccaccatgcccggcctctacagaacattttttacagatatataagataatagggtcaaaggctgagattttaaagttggtttaggccactgtggtaaatgagaatacaagatattttctaagcatgtccaaacatgaggaaggacaataacagctcagaaaaaagaaatttcattcgtgattcaagcaataacagcagaagatactccgtttaaaaattatggcagtagaagataaccaccattctggcacctacctttgttttcttctctgggcttggtgggagctccttgttcggtggggtggtgatgtcatttcctgtcccactcaccacaggccttccttcttctggcctggctattcctaaggggagagggtgagtgggaattatgctaagcaaacattttacatgcccattttgaaaatacaaggtttagcaaagacagaccactaactagcacttcattctgaaaaaagtccacagggttgtgctgctgaaatgtggacaagcctcccaagttctcattgtgatggaggacagttttagattcctcagattcagagagcctgaccctgtggagaagcagtctaagggacacatgcacaaatgatcagtggaaaaaaatggtcctttaagtttggtttcccttccctagagaccaaagggactctgtcttccaaccactagctctccaagcaataggacaaaaacctcttctaccagtctatctttggaataaaggttgctgtgagatgggataagagccagaagatcattcaatgactccctttccttcctttccctataaagaaccactttatggaggatgtgagattaacctgatccagttctaacagtgacccagattttcaacaaggccaaggagacccatggaaccagactcagggccagaaataaagtctcctgcctaaggcaacatagcctcctctctgtggagaggttactctggatttcaataggactatacctgagagcattaaaatactgtgaaatgtataaccttgctgtgggggaaggcatttctaactggcacaaagtcaagaggccacaagagataagtttgactaaagaaaaataaaaaacttcaatgtggcaaaaaacaaaataagacaaaacactataataaaagtcaaaaggcaaatgacaaacagaaaaaatacttgaccctcataccaaagacaaagagcttattctataaattactcccacaaatcagtaactgctacaaaggccaataatccactgggaaaatgcaaaacaatatgaacagactttatagaaaagagatacaaagttttttgaaactatgaaaagatgtacaatgttaagtataagaaaaataaaaaaaccccactgaaatgccattttattttttgagacaaagtcttgatctgtcacccaggctggagtgcaatgctgcgatctcggctcactgcaacctctgtctccccattcaaacaattctcctgcctcagcctcccaagtagctagattacaagcatgcaccaccacacccagctaatttctgtatttttagtagagacagggtttcaccatgttggccaggctggtctcaaactcctgacttcaagtgatccacccacctcagcctcccaaagtgctgggattacaggcatgaaccaccatgcctggcctgaaatgccattaatattaacatattgtcaaaagtcctaaaattttaaaataactactgagaataatatagggaaatatacttggtaggtatgtgaactgtatgacccataggcagggctgcctggcagtgtcattttctgaaaattacaaggacagataaattctaatctagaaaaccaatttctagtaatttatcctagaagtgtatttacacaccagccaaatagtaaatgtgcaaggtttccaccagatcattgtttctaaaagcaaaagaacaacccagaagtccgttaatagaaaactggttattatggtagaaatatcaatgtaatctctgaatgtgaaaaaataaagcatggagaaattcttttatgattactatgcaatggtctctattaagtgaaaaaaaaaacaacaaagcataagtataatgtgaaactatttgtcttgaaaagggatgagggaaaagatattgcaaatacacttatatatgcattttaaaagaatttttgaaaggattgtaattaaacagaacaacgtttttgagggaaaggatgggacacaaaactggggaggttaggaggcttaaaactttgagaaataattacagattcataggaagttgcaaagaaatacatagggaaggtccctgtgtacccttttacccagtctccccaagtgttgatatcctacgtaaatacagtatactatcaaaaccaagaaacagagacaacccacagagcctactcagatttttcactttacatgcactcatttgtgtgtgtgtgtgtttgtgtgtgtagtgctatgcaactttatcaagtgtagctttgtgtaaccaccaccaccaccttagcctcccaaagtgctgggattacagattacctggcctggagtggctggttacaatcaatagggcttcttcatgttacccctctatagccatatctaccccatcccctttccaatccctaaatatatggcaactactatgttctccatctctatagtaacttccagtacactatatttaaaagagtggtgcaagtagatatccttgccttgttcccaatcttagatagaaagtattcacttattcaccattaaatatgatgttagctgtaggctttctgtagacgctctttgtcaagttaaataagttcctctctattcctactttgctgagagttttaacatgaatggctatttgattctgttaaacgatttttctgtgtttacaatttattttcttcagactataacagattactttttttttttgagatggagtctcactttgtcgcccaggctggagtgcagtggtgtgatctcagctcactgcaagctccgcctcctgccattctcctgcctcagcctcccaagtagctgggactacagtacccgccaccacacctggctaattttttttttttttttttttttgcatttttagtagagatggggtttcaccatgttagccaggatggtctccatctcctgacctcgtgatccacctgcctcggcctcccaaaatgttgggattacaggtgtgagccaccacacctggctgacaattacttttgattattgcactaaccttgtatacctgaaataattccaatttcagttttttttttttttttttttttaagagatgaagtctgttgcctaggctgcagtacagtggcatgatcacagctcactgccacctggaactcctgggctcaagagaccctaatgcctcagccttccaagtagctgggactactggtacgtgccaccatacctgaataatttacaaaaaaaatttttttgaagagatggaggtcttgccatgtggcccaaactgaccggtctcaagcagtcctcccacatcagcttcccaaagtgctgggattataggcacaaaccaccatgccccatcataatttcaatcttttaaattgattcaagttggttttatgacccaagatccatcttggtgagtgtttaatggacacctgagaagaatgtacattctgtcactgagtggaatttctatcaatgtttatgagattttgttgtttgatggcactgttacatctttactaacattctgtctagtagttctatcaactgttcatagtgggttacagaagtccccagctgtaattgtgactttgtgtacttctccttttagctctgtcagtttttgtttcatatatcttgatgctctgttttttggtgtgtatacatttagaattgctaagttttctaaatgtaaggatcaatcttagtgggattgatcctttattcttttctccgacatctactttgtctgatgttagtatagtcactccaggacacgtaatctttaatcccagcactttgggaggctgaggcagaggatcacttgaggccagcagtttgagactagcctgggcaacaaagtgagacttcctctctacaaaaatcgaaagaaaattagtggggcatggtggtgtatgcctataagactcagatacttgggaggctgaggtgggaagattgcttgagcccagcgagtcaagcctgctgtgagctatgatcaggccactgcactccagcctgggcaacaagaaaaaacaactatatatatatatatatatatatatatatatatatatatatatatatatatgcataatcattatatatagctactgctactttaaaaaattgttaacatgatatatttctttccatcttttaactttcaacctacctatgtccttatgtttgttatgcatttcttgtagatagcatatacttgggcaatttttttttctttttaagacaggtgtgatcatggctgactgtactcactgtagcttctacctcctcggttcaagtgatcctcctacctcagctcctgaatagctaggaccacaggcatgtgccaccatgcctggctaatttttaaattatttgtagagatggggtctccctgggttgctcaggctggtctcgaactcctaggctcaagtgatccttctgcctcagcctcctaaagggattacaagcaggagccgctgtacctggcctacttgagtcattttttaaaaataatatactcttccaatctttgtcttttaattgtagtactcagaccatttgcttctaaaataattcctgatggccaggtacagtggctcacgcctgtaatccattcagcactttgggaggccgaggtgggcttatcacctgaagtcaggagttggagatcagcctggccaacagggtgaaaccccatctctactaaaaatacataaattagccgggcgttgtggtgggcgcctgtaatcccagctacttgggaggctgaggcaggagaatcgcttgaacctgggaagtgaaggttgcagtgatctgagattgtaccactgcactccagcctgggtgacaagagtgaaactccatctcagtaaataaaaaaataaatgaaataaagtaaaataattactgctatgttaaggcttaagtctgatattttattttttatttgttctctctttttctcatttctgtttcactttcctgccttcctgttggttacctgaacatttttaatctttttaatttccttttttcattttttcaaattacatctcacccaaggttacctgaacatttcttagaattctatttttattaaaaaaaagcttttgagtatattgctctgtatagttttcttagtggttgctctaggtattacaatatacatacaacaaactggtatcaatgttctactactgttttttcctctagagatggggtctcactgtgttgctcaggctggtctcaaactctgggctcaagtgatcctgccgtcttcagcctcctgagtagctgggactacagatgcacaccgccacacccagctatgttttactactttgagtgacctactggaaccttacttccatttaggatcctttattttctccctactttaatttttttttttaaagacagagtctcactctgtcgtccaggttggagtgtagtggcacaatctcggctcactgcaacctctgcctcccaggttcaagtgattctcatgcctcagccaaccgagcagctgggattacacgtgtgcgctaccatgcttggctaatttttctttttatctttagtagagatggggtttcgtcatgttgcccaggctggtctcaaactcctggcctcaggtgatccacccaccttggtctccaaaagtggtgggattacaggtgtgagccactgcgcccagccctaaaatatgtcttaagtgtttcctcttcatagattaagcactacatcagatggcattacaatttgtgcttcaaatatgatttatgactttaaaaaattcatgaggagataagtctattatattcctttttttttggagaccaagttttgctcttgttgctcaggctggagtgcagtggcatggctcaccacgacctccacctcccgagttcaagcgattctcctgcctcagccttcctgagtagctgggattacaggtatgcgtcaccacgcccggctaattttgtatttttagtagagacgggggtttctccatgttggtcaggctggtctcgaactcccgacctcagatgatccacccgccttggcctcccaaagtgctgggattacaggcatgagccaccatacctggctatttccatatttttacccattccattgttgttcttttatttctgaaattccaagcctccttctgttaccaaatcttatttttttggagagcctcctttagccattctctaagggtatgtctactagcaacaaattcttagttttcctttatctaaaaatgtcttttttatttatttccccttcattcctgatggattgttttaccaaataatttgcagttgacagttcttttcttttggcacttgaaaaatgttgtgccacttctttttgcattccccagtttctgataagaaacaggctgtcatttaaatgctgtttcctcagcaccataaggaaggttaaaaaaaaaaattgctgtttccctaatgcatcatatctctttgctttttttacagatttttgtctttagtttataaaagtttaattatgaaaagtcatggcatgatttctccacatttatcctatttggtatttgttcagttgcttgaatctgtaagttttgtcttttgtcaaatttgggatgtttgttgtcattatttctttgaacagttgttcagccttgcatccttgctcctctcctgagattctgatgatacaaatgttagatcttttgttattgtcccatgggtctgaagatatgttttttccttgtagaccattttttcgtctgttgttcagattgaataaatcctattgatctgtcctcaacgtcactgattctgtcctctgttatctgcagtctgctgctgagcccattgaagtttttaattttaattattatatttttcatattgacaattaacatttggttctttttatgtaacttctatttctttactgaggtttttagttttcatttgtttcaagagaattcataattgcttgttaaagcacttttatgatggctgctttaaaattctgattttgtactttagcatgcaatcaccctgtttatatttagtctacaggttatgactgtagttctgatgacaatttggttcctagagcccttgcaatgcatttatggcctgttgtgttctgattctgctaaggttctaactaatcccttttggtactgcctgaaagggctgtagggacttacctgtgtcacccagtgtcagcacataggggctgagtgatgctggaaacatagaatagagagcttcctctggactgctctctggctgcctgggacccaggcagacctcctgtttgatctctgctggggttgctgggagcaggaaacacctacctcgggggctttctcttgctaaggggaaggaagtagaggttctgaaacctacgaaagtctcctgcccctgggtagaggattacaagacaccagggctatagaagccactggtgctgttacctggtaggggacaggcctccctgcagttgctggtgatgtgggcggaccaggcctatagcttctgctgagtatggagtggacaacaggaaggcccttatgggctgcattgacactgtacctgcaggcagactgagcccactgctggggatgggtagtgaaacagggctcaccattaggtctttgctgggtttttttctttcttgtttttttggcaatagagaacagattttctctatttgttttcttttttcctttccttttcttttcagtctatgcctgttggtaattccaggttacaggcctctccagtgcccagccagggatatgtaggagacaaaaagaaaacccaggggatggacgcagtggctcatgcctgtaataccagcactttgggaggtcaagcaaggaggatcacttgaggtcaagaggtcaaggctagcctgggcaacatagcaagatcccatctctaccatcaatcaatcaatcaatcaatcaatcaatcaattcatcagtcccagggaattcactgtattgccattcctcaagtcctgagatccctaccaggtttgccttctttctacctcatattcttttatggaattatcttcaattatttccagactatttagttgtatttacaggggaggagcagaaaacaatgagatgataccatcttgtcttggtaggaggtttttgtaatggagagcactttgtactttttgatgtttgaaccatatgtacttttagtcaaaaactgagtatttttctagttttaaaatgtaatggggaaaaaccatagccaacaactgtgcaaatttgttaacgcctttgttcttttttttttttttttgagacggaatctcgctctgtcacccaggctggagtgcagtggcgccatctcggctcactgcaagctccgcctcctgggttcatgccattctcctgcctcagcctcccgagtagccgggactacaggcgcctgccaccacgcccaactaattctttgcatttttagtagagttggggtttcgctgtgttagccaggatggtctcgatctcctgacctcatgatccgcccgcctcggcctcccaaagtgttgggattacgggcgtgagccaccgcgcccggctaatgcctttgttctacagcaagctcaaagaagatcttacttgtgtaactagctgccactggccccagaccactataaatatttttcaataagttcagcatttttcagtaaacaacatatttcataaagtcgcattgtctatgatacaggcatgcagtaactcgacctatacaaataaatgtaactgtgcataagcagaaactgctttctctctcccagaaggtagttctcaccaagccctttcccttgtctcatggatatataaggcaacttcttttttgttgtttgttttgagacctgatcttgatctatctcccaggctggagcacagtggcatgatcttggctcactgcagccttgtccttttgggctcgagcaatcctcccacctcagcctcccaaacagttgggactataggtacatgccactatgcccacctaatttttgtatttttccatagagatgggttttttgccatgttgctcaggctggtctcaaactcctggcctcaagtaatctgcctgccaaggcctcccaaagtgctgagattacaggcatgagccaccaagcccagctatcaggcaatttctagagaccaccacccacatatccccagagtttcacaaaagcaatgtctgatgtggaacttactaactccttcaatgaactgtgctcttctgttgggtctttccattacctatactaccactggctgggaaaaccagcctcacatcacagcatgaccttcaattcctttttctcacacaccttccaaattccagtttcactttatcttcacctgttatatttcccctctcatatcctcagcgtttcatctgccactacctgaatcaaatttctaacaggattgtttgctttcaactctttgtcttccagttcatcacacttactgagaacaagtaaatcttcctaaagctgacctggagctactttatctgctatcataggcagtcaccacagtttcagaacatggtagtgagaggtgacagcgtgctggcagtcctcagagccctcgcttgctctcggcgcctcctctgcctgggttcccactttggcggcacttgaggggccctttggcccgccgctgcactgtgggaccccctttctgggctggccaaggccagagccagctccctcagcttgcagggaggtgtggaaggagaggcgcgagcaggaaccggggctgcgcgcagcacttgcgggtcagctggagttccgggtgggcgtgggcttggtgggccccgcacttggagcagccagccagccctgctggccccgggcaatgggggacttagcacccgggccagtggctgcagagggtgtactgagtcccccagcagtgccggcccataagtgctgcgctcgatttctcactgagccttagctgctttcccgcggggcagggctcgggacctgcagcccgccatgcctcagcctcccacccctccatgggctcctgtgccgcccgagcctccctgacaagcaccaccccctgctccacggcgcccagtcccatcaaccacccaaaggctgaggaatgcgaacgcaccacggcgcaggactggcaggcagctccacctgcagccccagtgcgagatccactaggtgaacccagctgggctcctgagtctggtggggacgtggagagtctttatatctacctcagggattgtaaatacaccaatcagcaccctgtgtttagctcaaggtttgtgaatccaccaatcgacactctgtatctagctgctctggtggggccttggaaaacctttatgtctagctcagggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctctgcatctagctcaaggtttgtaaacacaccaatcagcaccctgtgtttagctcaaggtttgtgagtgcaccaatcgacactctgtatctagctgctctggtggggccttggagaatctgtgtgtcgaaactctgtatctaactaatctgatggggacacggagaacctttgtatctagctcagggattgtaaacgcaccaatcagtgccctgacaaaacaggccactcggctctaccaatcagcaggatgtgggtgggcccagataagagaataaaagcaggctgcccgagccagcactggtaacccgctcgggtccccttccacactgtggaagctttgttctttcgttctttgcaataaatcttgctactgctcactctttgggtccactctgcttttatgagctgtaacactcaccgcgaagatctgcagcttcactcctgagcccagtgagaccacaaacccaccgggaggaacgaacaactccagacgcgctgccttaagagctgtaacactcactgccaaggtctgcagcttcactcctgagccagcaagaccacgaacccaccagaaggaagaaactccgaacacatctgaacatcagaagggacagactccagacgcaccaccttaagagctgtaacactcaccgcgagggtccgtggcttcattcttgaagtcagtgagaccaagaacccaccaattccagacacagtagtaagctttaaacttttcagtgggacatttgaagcttagcaagattggattccaaacaactttctagaattttctcccattatttcttgtcacatatgtaaagacggctttggaatatttccttaacctatactctctcctttagagaagcctcaaggtgaatgaagcgggtgggtctaaatggctcagattggttaagaaggctatgggacctggtatagagttgactggaccaagctgagccaataagatataattactcactcattgtcagtatagacaaagacatggaaatgacagtcatgcaacatcggaaccctgacatatatggtggtaacaaagctggccacagagctcaaaccatggcaactcaatgctattctgtcctgggcagagttacaagggaagcaaaaagagatgacagaggaaatacagatttttaaagggaagagaatggagtacatgtgcagggagaagcagaggtcccaagagagatatacacaatggcagcagcctggccacatttcctgtgactggatgccctgagattcctccattgttcttttacctaacatgagctgtctaggcttcatatctttgtttaatatgagttcccttgcctggaaggctttccctccgcattatttggcatcccagggttccaaggcccacctcaaatgtgacttcctccaaaatgtttccacaattcacaaccctcccactgcctcccagtcctccaactggatcaaaagttgcttgaggataaggataatttccagtgcctagatagtgaatgcaaatggtaggcatgttaaatgaaacaatcttcctataaaagttttatctacagagtggttagcagagtcagcatttaaacatttatcgggtgaatggatcggtggatttgtcagtcatctgaaatttttttctattagcacaaacttctgttagtctgaattagaaagaacttgttctgaaacaaagtcttcactcatgatcacctagaagttatgtggtactgaacaaagcacctggggatcaagaaaaagatgacaaagtcctgtccaggaagagcttacagttctgtcccagctagaaggaagcaacagcatgggacacctgaatgcttgtaattctggagtcataagaaatcaaagaggaactattaagcttctttgcctccataaaaaaacgtgttttttatctccataaaaaacaaaaaatgttttttatctccataaaaaaaaaaaacccaaaacatctgtatgtcttctacttaccactcccctagaaaataccatttcttactttcaaagaaaaaaagtacaatttcataaaaatatactgagagtaataaatattagagaaaacaggtcccaggaaacaagactatttttttttaaacaagcaaaacacatgttttaaatccccatttacaagtttgtgaattatggccctttgtgctcaaactggactcggagaaacacaagcttttttagaccaccacaataagagctgtggggggatgggagatggggaagaaaagaaagggccaggaagaaagacacaaaaggctgtcacaaagaccgcaaaatttagctgtttattaggttgcaagtctctccttctctccctgctttctctttcttctttttctccccacaaatcctctcaaaacacatacaaaaagagaaaactagaagcaagattgggtcaaacatgaagaacacagaaagaatattaaatagctagctttaaagggctctttttcagtttgaacaaaagtaaaacgttctccaaagcaaaaacagaaaacagagcttccacccagattgtgcaacttaatgagaggaggttagtgctgataaacccattgtgaatctatataaagtgacagattttcaagcaaggaaatcaatcagttgggattgaaggatttagagctcaggaatcatctggttcaaaccaacagggagctgagggctgggtggatgggggatgggttggacagggtgacatgaggtcaagaaagggggtctagtttttatacccaccattctctgaccccattccaccccaaacttgcacactcaattcacattatctgtcatgctagcaagacattcagcttgaccctgcaagattcactttgttctcttccttgcctcactcccagcaagcttccaacacaagggaattaagctttccccaggcagtcacagaacccagctgtaaaaagctgcttagtgctctgccggtaatctgtcactttggttccttccttgctgtctgcttgttcccaatggaggcaaaatttagaaacataccatcacgtgggggcttttcaaacaggaacgatggagtgctctgggttgcagtgacctcaatttctttcttccctgccagagccgtctgtcctggctgtttctctcctcgctggcaaacctgcgagcatgaatcaattctagtttcactaaaatcttcctgccctttttccttgctgcttccttcaggaatctgctccagcttactatggagatataatccagcagtgccgagttccttcttcccagagttgctgctgctgttgctgaagtgagccaattcttctctcttcttggccactggttcctcacagatgaaaggaggtatctctttagtagacaagatgggcagtttcccagggctcaatttgtagctagctgtctgttcctcacccacagtcatggagcgcttcatagcaggagctcccagtttcccaggtgtaggactaggcattgggctactagggggaggcagcaggccagaagaaggctcttctcgggcagggagttcagggtacttatctgcaaggttgacagctgggggaactgagaggtgagaacattcagacagggccctgcgcactgcctttttctgctggggggcttggttgagcacagcctcctcggtagaactcaatttctccaactccttatcatggtctctgatgtgacagcttgcattcaaatgttcctgggtgaacaccatagtgattggcggaatggtggtgggtgaatgctcaataatgggggctgggtgggctagagacaccaggagtggggactcacacttcagctgctcagagttatcatttaccaccccaatcactgggcagccaggggtgatgctattctccatctctcccggagttgcttcccttgagcccagagagccttgagccactggatgaaagctggggttccaaacactggtttcctgctccttaacatatctggtagggatgtcagcagccccagggaaatccagatctgactggctcttggtctctagtccattcttccctgccaccttcccctgaactggaatggttttgtttttgtctggcccctctatgagtcccagatggaactcggaggtcttctggtgtaccgagttcccctccaagggatggcaggtctctgaaatcacatacctgctctcaaggtgacctgaggcttcttgacagtccttgtcctgcatttcaatgctcagctctttgtctagcttcccctcaaaaaagcagagcttgttctgctccaggaagctggcattcttcacaagcccatcttttggttgcccgtccatgctgacattcagcccaatttcattcagtttgccctctgtcctctgccattcgaatccggcttgactgatttcttttggggagtccattcggcactctgcaggcttgcccttactgagctgaccgtacgcggcagtgagagaggctgtctgcttgtctgagagcgacatcgtctctcctccactgctctccctgctttcgctcctggagctctaataccacctacgatcacacagagcttgcagtgacatcacaccaattccccagtattcatgacaaaattcatctctccctcaatgcccctctctcctcaagcagttgagtattaaatgcacttacaaatgtgaaagaaagaaagaaaggaagaatgaatgaaagcgaaagaaaggaaggaacctgctgctttctgcacaacaaaatgctactttaatctgagaatgtaatttcccgtgaactagcactctgtttagatctgcaatttaaaacacagtatggtgccaatccaagcactaaggatagtaattattttggctttcactgatatagatacgtgcatacccacacactcatttatctgataccatgcccacccttccacattcaaccactcagaaaactgttttaaaaataaccgagactcatttgccaatccccagctataaccctgaagaacaatgaatccaggaaattgttcaaaattggactaaaaaaaaaaaaaaaaaaccacaccttaacgtagtattaagattgcaggcattcattctcagaggaagagtgggtttgctgtcatagcaacttatcaaactaacttgaaaactgacttgagtggggtccccaaaacccgtaagagctccatctgtagctctgcataatggaagagtttaataaagggttcatttaaagacttcagtgatcagggctttggggatagatattctaattataagacatttgtgtgacaacataccccttatgcatttacgcctgtccctgcccccacttggttccttggatgagctgggttgctccctccactaccaagccctgctctttccagcctaataatctgttaggtgtcatgtgaacacactgggggcagtgcatctttctctgacctccagacttagggactctaacaattgtagcttggagttttccccactcaccagagcttactgcccccatttaactcagcatggtcctttgctgccctgggctttgagctcaaatattgtatattcaaactgaaggaaccataaaacaaaactgtgagaaaaaaattacactataaggacaggctatactcttactttgaacaaagctgatttttcttgtctagctgtaagttactgtcttgcaataacatagcatactggaaatattctatcagaaatccaagagaagtctttttccaagatgaagaaaagatttagattgctttttttttttttttaaaaaaaggccatttgccataaactgcaatgatttgatgacagtttttaaacaatgcctttagaaaaaagggcaagttaagattgttctttggtctataaaatgtaaagaaattaccaaggtccgcataggaaagcttgctaaactgtagcctctgtccccaagaactcaccttctctattcataccactcaagttcccaacaagagtacagggatcaaccttatataccttttccattaccttcagtacctgacacagggctacactcatgatgatgagtggcaatgttgcaatgctgaaaaaaaaaaactgaacatgaactgagcctcatatacatttcttccccttgatcttgagctgtttagtaacaatacatgacaaagcacaatacagattaactggcaaggaacctggtttccatactctatggcaaagatcttgctaaggaaaaggaagtgaggtataacaaaatgaagaatgccaggagaatcatgattctaattagtaacaagaaaaaatatgattggccgggtgtggtggctcacgcctgtaatcccagcactttgggagcccaaggcaggtggatcacgaggtcaggagatcgagaccatcctggctaacatggtgaaaccctgtctctactaaaaaatacaaaaaattagctgggcatggtggtgggtgcctgtagtcccagctactcaggaggctgaggcaggagaatggcgtgaacccacgaggcggagcttgcagtgagctgagatcacgccactgcactccagcctgggcgacagggcaagactccgtctcaaaaaataaaaaaaaaagaaaaaatatgaggcgagattgggtacagaaaggccttggtaatacaacatagttgaattcttgctttctttttttatacatataattgaataatataattaagtatgtacaatatgtgaggaaaattatgaaagtctggagatggctgggtgccatggctcacacctgtaatcccagcactttgggaggctgaggtgggcagattgcttgagcccaggagtttgagaccagcctgggcaacatggcaaaaccctgtctctacaaagagtacaaaaatttaggtgggcatggtgatcacaattgtggtcccagctactcagaaggctgaggtgggagaattgcctgagcccagtaagtcaaggctgcagtgggccgtgatcacatcactgcactccagcctgggtgagaggaaaccctgtccaaaaaaaaaaaaaagggggtgaggaagatattgttgtaatacagtctgaatataccagaggaaaactctggaaaataccttagaaatcaggtaagcctcaacaaccccattctgtgtaaactagtcaccccccacaaacgacacacacatatacacccttaatttactgacatggtggggaaaaaattaatttgactttgagtcagaaggccagattttaaaatctgtgtcacttaatagttaagagtcttagaaactcatttaactgctcttagcttcagtttcttcctctataaaaggaggggaatctttaaggtgctcttggattcagttttaccactttcacttctgaagttgaaacagccattcaagtaatcacaggcccactgctatgtccagctcaaagtatgacttcaacctgggactccactaggcagtatcttcagtaacctttctgtctcatgcgggagtgctgcctattggcagaggcatgactgggcatggcggacgttgcagcatgtctgaagaaagtggtagttggcccttatattctgaagaagtggaaaataccaaggcaaagaacaagcatagaaacttgttccttatagccaaattatttttagttctggccagcctacccagacccacttcactagttcatccctacccaacagctaaggcaataactaaaattacaggtctctgctaccttcagatatcacatattctgcctcagtaattctatccataaacagcagactgcaaaatgtgaaccagccaaaagaccaagagcagaaaccagaagaatgaagctagtcaggcacaaagaagtgcatattccagactacagttcatactgtgtagatcagaaatgtggtcaaactgaaaaaatataattatgaggtcaacatctagcaactgggccaagcactggcttcatagttacaaggctcaggagacagagagttgaaagaagcaatctggggtgggggggcggtcagaacaagaagttcaagcccatagaaggggcgagtacccaagacatcatgtcagccaggtgctcaggcatacagataagtttggtggtcacccaggggtctgagtacaacaaaacacatagccgtgaggattgagggaatatatataaaaagcatttgacaaagtagttaaaacacacaaatacataatgtatctactgatgctagctttaaaaaaacaaccaagaaggccgggcgcggtggctcacgcctgtaatcccagctctttgggaggccgaggcgggaggatcacctgaggttgggagttcgagaccagcctgaacaacatggagaaaccccgtgtctactaaaaatacaaaattagccgggcgtggtggcacatgcctgtaatcccagctactcgggaggctgaggcaggagaatcgcttgaacccgggaggcagaggttgcagtgagtggagatcatgccattgcactccagcctgggcaacaagagcgaaactccatctccaaacaaacaaacaaaaaaacaaccaagaaactgtacatatatatatatgaagtaggttttcctactccctatagggaatctgatgtgtagtaataataacaacaacaacaacaaaagtgagaaagcctaagtccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatctggggcactgcctaaggaaagtaaataacctattccctgaatcccttttaggacaagggtccattatatccatcaacagtactgcaaagacactaaagtatgtgtgacagtacagagtcagaatgctgaggcttccctaacagacccctcattttatagaggaacaaaatggtgtccagagaaaaaaagtggtttgcccatgatcacatggtgaaaacttaatggaaaagccacaaagaagatgctaggtttctgactgccagtcttcccaaaccgctgagcaaaaattaatcttagtcactagatgactctccttttcgatgtatctttatttttttgagagggggtctcgctttgttgcccaggctggagtgcagtggcatgatctcggctaactacaacctctgcctcccaggctcaagcgattctcctgcctcagcttccggagtagctgggattacaggcccacaccaccacacctgactaatttttgtatttttagtagagacagggtttcacgatgttggccaggctggtcttgaacttctgacctcaggtgatctgcccaactcggcctccccaagtgctgggattacagctgtgggcattgcgctcggcccaatgtatcttttttgtgatcattgaagtacttcaaactttaatttggaattataatttaattcttttgtgatcactccaaaactcccaaattaatacacagtatgcatacacatgtgtgtgtatgtatgtgtgtttaggggagcaaacgcgtgtttgaagtaagggagaaaaagaggcaatgcacttggtttcggtgtttactttatatcttaagaacggtcttgtttgaggccgggagtagtggctcatgcctgtaatctcagtactttgggaggtcgaggcgggcggatcacaaggtcaggagttcgagaccagcctggccaacatggtgaaaccctgtctccactaaaaaaagatacaaaaaattagctgggtgtggtggcaggtacctgtaatcccagctactcgggagtctgaggcaggagaatcgcttgaacctgggaggtggaggctgcagtgagccgagatcccaccactgcactccaggccaggcaacagagtgagactccatatcgggggggggaaaaaaaaaaaagaaagaatggtcctgctttaattatgcaaagagtaagatgtgggtgacttattccttagcaaacttctgtttctaatttccagtcttaagagaacttagatttatgttaatatctttctatggtgccttagcactgtaagtttcctttcatgtggcttctgagtaggaagacagattcagcctcactaagaaaaagcagagaaccagacgcttttacagagggggaagggacagagtagcttctagtttcattacactaggctgggcatggtggctcacccctgtaatcccagcactttgggaggcagaggcaggtggatcatgaggtcaagagatcgagaccatcctggccaacgtgatgaaaccctgtctctagtgaaaatacaaaaattagctgggcgtggtggcacgcacctgtagtcccagctacccgggaggctgaggcaggagaattgcttgaatccgggaggcagaggttgcagtgagctgagatcgcgccactgcactccagcctgccaacagggcgagactccgcctcaaaaaaaaaaaaaaaagattacactattgcttttgcaaggcatacaaagatattaaatggaagaataattaatggctttgttgcaccccaaatgaggtgaatgccacctggatgacaaatgatggggaaaccctagtatagaataattagtaaaactcaagaaagactgggcatagtagcccacgcctgtaacaccagcactttagaagggttaggtgggaggaccacttgaggccaagagttcaagagcctgggcaacatagcaggacccacatctatacaaaaaaaataagaaaaaaatgttttttagccaggtgtggtggtgcatgcccatagtactagctacttgggaggctgaagaaggaggatcacttaaacctaagagtctgaggctgcagtgagtgaactatgatcacgccactgcactccagcctgagcgacagagaccttgtttaaaaacaaaacaaaacaacccacagaacaccctgagaatggccagttcagtactccagtccaaataagaattacagacataatctcaatcagggatgcagatttatccacaggaaatagccacagcaagaaactccaatctcccagccactgtaaaattatatcaagttggtggatgaggtaaatacatgaagtttgaaaagggtgagcctgcctaggtaaaaagaaacacacttaagaaccagaaggactaagtcctagattcagctgccactgggattccttgtctctaggttcttcctccccaggagctgggattacaggtgtcccagctaatcaccacacccagctaatttttgtatttttagtatacacagggtttcactatgttggccaggctaatctggaactcctaacctcaggtgatcctcctgcctcagcctcccaaagtgctgggattacaagtgtgaaccaccgcacccggccccttgcctctaggtcctattcctactcactcacctctgcaaagtctctttgaacccctcctgagttctttatattatcataatactctatctctttttagaatttagaaaccacactgtaatcttttatttatatgactttcccaggagcttctagaaggtaggaatgtgaactgtgcatttgtgccatgtgggtgcactgcacagtgcttgactcacagtaaataagctttcaaaaaagatctgctcagtgaaaggatgggtagtttccttttacactgcatctgcatcatttgacctgatccgttccatcattaaagctgtcttcaacccaacccaagcggtggtgatctggaatgtcctttgagctaaatattgtgaagttctattccattctgtctgagtttgaagaaagcgcatggattcctgtgtgtctgggcagaaggtggtttccaggactcttggcaaagcctgcaggtctctaatcccagtacatgtactggcagatatttctgttttagccttgtgcttggagttagtatttaacctgttcagggccttggtttttatacatgacagacaactagtttctctgcattctttcttatcagttaccaaggcaacactactttccagattgaccaactgttcccagttattgcctccaggaaacaattatcattacaatgaaagtcaataattctactattaacaatgattgatgacactcactccttgttaataaaagataaagttgtcaagttataatctagtttcttccctggaagtaaacgttccaagtgtttagacatacatacataaaggtaaaactatttcagaaaccatattctacattttagaaacatttctcatgttttaactcaagaaaataaatcatgattctccctgattaaaaaaaggatgagaagcaaacagacagaatgaataagctgaggcgaataatctgatatatgtgaaccaaagacatgaaaatgcttatggataagaaatcctctaaaggccgggcatggtagctaaggcctgtaatcccagcactttgggaggctgaggcaggcgcatcacctgctggagtttgagactagcctggccaacatggtgaaaccctgtctctactaaaaatacaaaaactagctgggtgcggtggtgtgcacctgtagtcccagctacttgggaggctgaggcaggagaatcgcttgaacctgggaggtggagattacagtgagccgagatggcgccactgcactccagcctgggctacagagggagactgtctcaaaacaacaacaacaacaacaacaacaactctaaaaactacaacttggaaatatcaagtctttgttcttttaagtctagtatggaccctcccatagccctccccaaaagaaaagagaatcatccaactaaactaggtagaaagataacccatttcttcaagcaaaaatctaagatcttctgcttttagaggcacacaatacccctaggatcctttaggagcttactttcttttccccaatttcatctcaaaatgtttaacagatgtccctgtttccccaaacttgactttattccatgcacctgcacttcactatgcatgcctttacacagctgtcccctagaattctttaccttaatttgctcagcaaactcttagccatactttcagagtctcctgtgtgaagatttctctaggtcttgtaggaaaacttagtccctttctgctctgtatttccataggatctagctcacacttctatcctttttcagaggagtaaacttctcttactagaggaaaactgtctgttttccaccctggaatctctgaagagtatagaatgtgttttattagtctatttttagagtaggagtaatgtcacttggtatctactgaatgaatgaataaactaaatactaaaaagtacaaatcatgctgtgtgtccgctatttgcagagcaataggcaatgtttatacacttcaggaggccgaggtggacggatcacttgagctcaggagttcaagactaggttgtgcaacatggccaaacccagcctctacaaaaaatacaaaaattagccgggcacggaggcacgcacctgtagttccagctacttgcaactgaggtgggagtatcacctgagcccaggaggcggaggctgtagtcagctgagactgtaccactgcaccccagcctgggcaactgagcaagaccctatttaaaaaaaaaaaaaagaatggaagcccccttactgtcacctccatatcttaaagaaataactatatctgcaatactgtaaatcaaaactaagtttttattttaacagtgtgttcagaatcccccaatgctatttgtcaaccagagggtacaagtgaagggtgagggaatatgaggggaagaagcttcttttaaagtaggatattcaagccaggcatggtgcctcacacctagaatctcagcactttgggaggccaaggaggaaggattgcttgaggccagaagtttgagactagcctgggcaacagagtgagaccccatctctacaaaaaatattcaccaggtatggtggtgcacacctgtagtctcaactacttgggaggctgaggcaggaggattacttgagcctgggaggtcgaggctgtagtaagccgtgatcatgccactgcacttcagcctgggtgacaaagtgataccttgtctcaaaaaaataaatacaaatttaacaaaacaaagtaggataatcaattgttgcttgattcatttcaaagaatatttaaatgttctggctcaaacaaggtaatgaccacacagtattttttggaggttaagagtttaggatggcaatgagtatatagtaaggttcaataaatggtagctatttttagttgtgtgactagtcccaataaatttcatcagcatggtagtaaaaaaaagccagtggagtcaggcgcagtggctcatgcctgtagtcccagcactttgggagaccgaggtgggtggatcacgaggtcaggagttcaagaccagcctggctaacatggttaaaccccatctctactaaaaatacaaaaattagccgggcgtggtgacacatgcctataatcccaactactcaggaggctgaggcaggagaactgcttgaacccaggagccagaggttgcagtgagccgagattgtgccactgcactcctgcctgggcgacagagggagactctgtctcaaaaaaaaaaaaaaaaaaaaaaaaaaagaagccagttgaatcagagggcaagtggggtgagagtaatgaggaaaggaacttcacaaatggcactacagttaagaaaagacattaccaaatgggtacttctccagttgtaaaatagtagcaagttctaagataacaaatggttttttcatctgctgagcatattttatttatgtacaagggccttgaaactgttagaattctgggtttataaattacttcaagtttcacaccaagagagtttctcaccataaactgacattcccagctgctggtagacagttgatgagctcaagcaaactgaagaaagaaatgaaagccagattataagaagaccaggcttcactatggcaaagggagggcctatttacagggatcccaaactgtcccattcacagtagcagcatagcaagtacactgtcactcacagttctacttggtttccaggggaacaactaacatggagcgggtattggaatctaatgtggatcatcctttcaagtttgtgcttcccttcacaaaaaacacaatcccataagaagtccttttctggccaggtgcggtggctcacccttgtaatcccagcactttgggaggccaaggcgggcggatcacgaggtcaggagatcgagaccatcctggctaacacggtgaaaccccgtctctactaaaaatacaaaaaattagccaggcatagtggtgggcgcctgtagtcccagctactcgggaggctgaggcaggagaacggcgtgaacctgggaggcagagcgtgcagtgagccgagatcgcgccactgcactctcgccttggcgaaagagcgagactccgtctcaaaaaaaaaaaaaaaaaaagtccttttctgaaaagttgagcttagacttcctgacgtattgcattaatcttccctgcctggaagaacatgcatagtatgcaaagaaaccttctgttaaagtttccctaaatttgacagcagcatgaaaaaataacagtagagcaaacagtaagctggaagagactttggcaatatattcactttccctacttctaaacagggtaagatcagcaaaaagataattcacttataattcaaaaaatgtcattaggcatcatgtatatataaagctctaggctgggtgttaaaaagtacatgtaaataaatcaaacacagactctctggacaataaaatgctagacagagtcaaaagacctagattctaatcctaaattaacctctaattcacagtttatattttcatgatgtatctttatttctccaagtagaaaagtgtttaattagtgcctagatactaaaaaaagtctattttatgtttactaattgtcaaccttcatctttttctttttaagtacctgaaacttccggaagcttctgaagcaagtctaagaaaagcatggatcttagaaacataaagacttggattcaaattctaaccctggcacttcaccagctatgtgaccttgacagcctccattttctcacctgaaaaatggagataatctttaatagtgttattttatgtgtgtgtgtatgatctatttacctatttccagataaccaggcaaataaaatcaactcaataggtggtaggtgctattattattattattattttttgagatggagtctcactctgtctcccaggctggagtgcagtggtgcgatcttggctcactgcaacctctgcctcctaggttcaagaaattctcctgagcctcctgagtagctgggattacaggcgtgcgctgtcatacccagctaatttttgtatttttagtagagatggggtttcaccatgttggccaggctggtctcgaactcctgacctcaggtgatctgctgcgcctggccagtgctattattattaacacccggattagttagaggtactattatttttactaacaccactaataatatcttttttttttttgggcgggggggctagagaggggcggggcgggggatggagtctcactcactctatcgcccaggctggagggcagtgttgtgatcttggcttactggaacctctgcctcttgggttcaagagagcgattctcctgcctcagtctcctgagtaggtggaattacaggcatgcaacatcatgcgtggctactttttgtatttttagtagagatggggtttcaccatgttggccaggctggtcttgaactcctggcctcaagtgatttgcctacctcagcctcccaaagtgctgggactacaggtgtgagccactgtgcccagccaacaccatttgtaatatctttactgtccaaacaatggaaaccatgggtgacaccatttgaccacaagacgaatgagaacaagatatgtgagaattggtagcaatatgggggcagggcagttaacatgaatgattcaaagtgaggaacaaagataaacaccagtgatggactaacaaaacatgtgaacacattatgctgttcgacagaaaaactcgatatgcaagacataaactctccctacgataagctagaaacagtgacttcaagaaaaatattgagtggattaatttttcttctacaaaactaaaaaataagaataggacaactctgaaaaagaataatagggcaaggggttgggctagccctattagatattaaaatatattaggaagcctggtggaaagatcaatggatcaggaaagaaagtccagaaatagaccaaatacatgcagaaatttagggtatgacaaaggtggcagttcagtgggagatcgattataaacatgatggtgggatgaccaagtaaccctgcctcacaaccttataaacaaaacataccaaaacaacaacaacaacaaaaaaaaaaaaccccacaaacaagcaaattctagattggccaacaatttaaaatgaaaaatattaatagaagagaaaagaaaatattttcataatttcagagcatggattggcttttataaacttgttaatacatgaagaagtcactaaaaaaaaaataaaacacagccaggcatggtagctcatgcctgtaatcccagcactttgggaggctgaggcaagtggatcgcctaaggtcaggagttcaagaccagcctggccaacatagtgaaacccagctctactaaaaatacaaaaaattagctgagcgtggtggtaggcacctataatcctagctactagggaggctgaggtaggagaatcgcttgaacctgggaggtggaggttgcagtgagccaagatcgtgccattgcactccagcctgggcaacaagagtgaaactccatctcaaaaaacaaaaaaaacaaacaaaaaacagcacacacacaaaatctatgccatgaaataatttttcaccgattagatcagtacacataaccaaaaaaaaaaaaaaaatcacactagtagagaaaggcagggaaacaggtatttgtctatgttgagggtgggagtagagatgtacctttctctacaagggacatctctgtaggcctacagagagcaatatggaacacccatcaaaattatgaatacatattcttcaaaccagagattcttactccggagcccctttttattacacagacgcacacacatgaagatgacatcctatagatacaaagatagtttatgtaccatatttctaatgaaaaaaagttgggaaacacctaaatgtgcatcagtaaagaagtactggccaggcacggtggctcaacacctgtaattccaacactttggggaggctgaggcagacagatcacctgaggttgggagtttgagatcagcctgaccaacatggagaaaccccgtctctattaaaaatacaaaattagctgggcgtggtggtgcatgcctgtaatcccagctactcgggaggctgaggcaggagaatcacttgaacccaggaggcagaggttgcggtgaactgagatcatgccattgcactccttcgtgggcaatgagagcaaaactctgtctcaaaaaaaaaaaaagtactataatacattagtatatacctatgtaatgaaatagtatacagctatcaaaaaagaatgagtcatatctagagacatgtaccaggaaaaaagattaaaaaaaaaaacaaaaaaaagaggcctctttctttatactgattcttttttttttttgaaatggagtttccctcttgtggcccaggctggggtgcagtggcgcgatctcggctcactgcaacctccacctcccagattcaagtgattctcctgcctcatcctcccaagtagctgggattacaggcatgcaccaccacacccagctagttttgtatttttagtagagatggggtttctccacgttggtgaggctggtctcgaactcctgacctcaggtgatccgcctgcctcggcctcccaaagtgctgggattataggtgtgagccactgcgcctggcttctttatactgagtcttaaaagatctctttaaaaattaagtttaaaaagaatagcacacatcagtatgtatgtatacgtctcatttatatgaaatcaggaaatatatatgttattacttattatacataaattgtctggaaggatatataagctattgtgaacactggttgctctggagagggaaagctggaaggcggttaatggagggaggccaacttacgttttactgtatactcctttgtaccatgtgaatgtattaacctattcgacaattagtttaaaaatttttttttaactattaaaaaggtatacattgtccttaggggaaaggtgtggtagaatttatagaagaaacaataaattttgtcccaaacccattatccttcccatacccactctgtaaggccactgctaacacagtctctgagcctgacctgacccaggcagggccccaaaagttctgcagtactggtcttgcttcctcaagaaaaacaaatcctctttctgcatttctttggaaatactgagcaaaaagagatggctgggatttcacagaaattacatgttaacttttagatcactgctgaaactaaagaatgggtctagaaaccaaaacgaaagaactggatagaacactggaaatctcaatgaatgctggaaagccctctacatactatttcattttctgccttggtaatagggtagctaatagaagataaaaacagagaagatgagaatgtcttatgcaaataacaacctttagcattctttactcacacagcagtattccttagtgggtacatactcatgcatagacaagctttacccaaaagaacaagtccataccatgcagaacacaatcccatgatgaaacctctctaaaagcctgactggctactaaaaccaattggtgttttttttaaattctggagttagtagctacatcatgcaagctgggaaacagtgattaagaaatagtgtcacttgtaggctgtgaaaaatctcaaagacaagggaacattttttgaaagctagattcagggaagccacgattaaatgtatacttttttggggaattgggggtggggggaaacggggctaccatttctaaatcttaaaggaatcatcttcttaatctcattccaattacttgactgaatagagccaaaaaagagtaaaattatgaggaacacaacatgggcaagttttatggactatgtttgatggacacagactatgcccaaaactcaaacccacatggaactgtggggcaatggatataagcaacaaactggtcaaaaaatgtatctgtatcattgagagatcatttcccattactagaaacacaaataaatcggtgcctaccaatgctggtttgaggccaccatttcctcataaggaggtggactgatttcatttaacctaaaagcagtttggatatttagtcccaccagcacaagctacatataaattgaaaaaaatctcatgcacatagctagacatgaaatattttctttcctcctgtgaatccttataccaagtaatgattaaaatttagctgtaaacttgatacataggaggcacaattttaaaaaaattaagaaatggatgatgataggtcttttgttagacaattcattgaaaattcaacttcccctaaaattcaacgttcagtgctgggtaaaaaaggcatgcaaccaagttaccagcctcctcaagcaggacacaaggaacacattggctgcagaaaacacaccgtagcagttataggtttcatgccaacaaaccaatgattaacaaggatgattagagtctggatggagccaagacacaagctctttgcctttctgatgctgactcaaaagccacaagcacacacatttccccatggcaggttcataccagcggacttcagttgcttatgtctctcttgttcctggattgtagactttggcaaaagtggagtaagtcctcgggacttggtgggtctcatgtagcctttcattggttctgccattctgcttttatcttcctttttcccttctcctggtgtctttgattcagatttttctgtcattttctgaggtgtctccaaaatcttatctttgggttctgggagtcgaacacccttggaagcagtcattattactaacgtatccgccacctctgaaggaggagcttcgactttgctatgtaagaaatctgactggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagaggagatgatttatttatcagctctgatggtgttctgggacaggtaaatgtaatatttctattttcgtccatataggccattccttcaattccctggtcccctgtggtttccatgggaacatgtatttttgttgcatctatcttattctccagaatgtgcttctcaggagaactatttttaacctttttactttttccatcattactccttttacttggtttgtcagccactgcagtgtatctattggctgcatctgtcttattctcctcagatactactgaaggaacaaatcctgccccctggatttgctcttggcagctcacatctgtcaccttggcaggtggttcagtaacagtagaagccttgactgtgcttatcttgttttccccaagagtcccaagctcaacaaaattaacctgaaaatttccacccttcctgtcaactgcttccactgtgggtgtatctggtgtatgtgagaacgaagaatcatgcattttggggaaagtaaatcctatttccttgcttttatggggaatactaccagtatctccatccttcccttcaaaaggtgggttaaggatttcttccttcctctccattctagcaggctgtgtggaataattatttttaaactttttgcttttgccttcattgcctctctttttaggcttttcagaaatccagggagctgcctcatgatccttccatggacaccttccttccttgctctggttattgacacccatatctttgactacatctcctgtttctgtgctaacaccagaagtctgagtcatgcctgatccactttccaaaggaatcaatgcctgcatggtgcctgccaccttaggctgagtcatctctttaggctcccccatcaccactgcctccgtgagatcagccttagtgcctggttgctttgaagaattcagccccagctcctcactcttatcctgagtagtcattccttcagttttagagactggctcactcggtatgagaacagcccttccgtccttctggctgtccagaagaaatggcagctcagattttgcttttaccttcccagaatctgttctcattttcccagaacttccccttcccttcctgcttttgccatcacctgccattctcttaaatggttcattctctaccccagggacctgtaccaacacttggccctgcagctgctcagaagtaaagatgctgatctcttgtctttcgttgggaaaagcttccttttttagttctttatcctcttcagctccttcaggaaactccttcagtttgacattctgcagtttagtcattttactttcattattcccttcttttagattacattctaatggattacttgctatcaaagtgggtaccaaatttggtatttcttttgctgctgtgggttttgaaactacacccataacctcttggtccaagaaaggagagcaaccctctttaagtctgatatccaaaggggtttctacattgtatgcagaaacttctgctaggggtcctttcagattgagagggcctactgactggcttttatctacaggagtcttcaggtggggtgcaggctgtggtttgtattcatgttgcttcagcaatttcttgtcttggttttgtagtactgacttgttacttttgctctcttcctctactctcagcttagactgagaacttattgcagttttgggggcttcttcagaaggatataaaggaattctgagactctctgagacaaagttctcagctaccagtctggctgcactggagttaactaaacattcccttttcaagttttctccagatacaagtccatattctgtacccatagtggtaggctggctggggagaacacctgatttttgtgtgtcagctgcaaatggatgacctttaggcttatctgcattgtcatcatccgaaggtcctccagcccgtggttgagaatatctcttttgctttggtttcttcttctttttcttcatcattattggtgtgctttctatatcccaggcctccctgccaagatccctctggggttcaagtgagtcaacatgaatactttttctttggttcccaggcccaccacaggaggatgaaccagagacccaacctgactcagacaaagagcagtggcccagcctgtgatcaagagtcttccatggaggagagcctcccagcagctcaggagggaccctggcaggcttgggccgggttgacctgcggtcactgggtctgcaaacttgtttggcttgtgtgggaggggtaccgcaatacatgaagttggctaaaattccaaacaaaaaactcctcgttattgtttcttaaaaacaacaaaaaacaaacaaacaaacaaaaaaaccagaccatataaatgactaatttaaggaggctattttcactaatacatatagtacttactgtaatttgctcaggaaaacagtcttttctaaaacatttctcacttttaactggcgctagcaaaaatatttaacagatcatcatctcaggtaaagattgttttcaaacatttataaaatatttgaaatttcagaagtagcaggattgaacttttaaaaatgaaacatttcacatcttttaacctctaaaaataagcacttactgcctgtaaatctcatctgatttatattggtcattcttagtgcttgcctctttttggtgaaatttattaattgcttcagttaaatatacatgattttggacaaaatttataattctaagactaggtcaccaatattaaactaatacttgtcaaacaaaccagacagattctgggaactagatcagaaggccagacttaagtcacttcacgcacacacacaaaatatactgaatccacattttggtcagagaaaaattctcatgattccagaaccagagcatcctactttgaaagacaaatatgttaaatttcaacattctgctcctaaatgtacttcccaaaagacagagaaatatatataatgttaagtaggataattaattttaacaattaagatgagtacctttggaagagtttcagcaggtgatctggtctaaccttcctcccagttaatataatatggatccaagatcctggcaagagtctcattaagagcaggtatatgccagctcctgtcaagtctgacccaataaattgatttccaagaatattataatatgtaaatagtggatttcattcttgtccttacccctccaatatcctctaaatcctagcctttgtttaatatctcaggttaattattgcatcgctcaaaaaattgctaggctatagtatcccccagtatttataacatttaattcagcaattaatcagcagctattcagtgccatcttttatactattttattcaattattatgtaaatcttgggtttcagagttcatgcctgagaacttatctcttcattcaggttataatataataattcagggggcaaggacggggacttaaatatctatatgccttaacatggtgtattttgtataccataagcacttgataaatctttactgatttgttgagtcagtaaaacaacatttaaaaaaaaaatcacacatttatttaagctctagtcttgtgctaggtagtgtgcaaagcattagagattctaagtgaaataagtcatgggcccttatgtcccatatgtcaggatgtccacattccaatcatagtcacagaaaagtaaacagaaaatcaagttgataatcatatacatatgcttctgggttattaaaaacaggtaatcttcaaattcactgaataatcaaactttaaattggaaagtatcttagagcagtacctctcaaagtttaatgaaaattagaattatctggggatctaattaaaatgcagataataattacaaaggcctaaggtagagcccaagattctgcatttctaccagcctctcaggtaatgtagatgctgttgggccatggaacactgtaactagtaagactttagagaacatttgaccaattaatttatattatagctaagtaaactgagatataggcaagttatgtaacttgcttaagaccacacaggatagaatagtgaatagctgaaccagatcaaaatttgggtgtcctttcttcactatgaaaacagtggagaaggccaggcacggtcgctcacgcctgtaatcccaacactttgggaggctgaggtgggcagatcaccagaggtcaggagtttgagaccagcctggccaacatggtgaaacctcatctctactaaaaattagccgggcatggtggcaggcgcctgtaatcccagctactcaggaggctgaggcaggagaatcgcttgaacccagtaggtggaggatgcagtgagccaagatcacgccattgcacgccagcctgggcgacagagtgagactctgtctcaaaaaaaaaaaaacaacgacaacaacaacaaaaaaaacagtggagaaaaaaaaaattaggtatcctgatttgctgtagtagtaatttttaaagatataacaagctgacattctgtctaaaccagataaaatctgtctaagagaattgacttcataaactatactgctgattaccaccatacaacagggaactagagacaatgtctaccatcactactctatcgcccctaatttgtttcaaagagttcattttgttttcctaacttacctgaggtctctgaagaaagctcagaaggttgactgttgcatggtttcctttcccctagtttttctaacacagaatcctcctcggccggcaagctgcactttttccccgttcctgtgacggtttctaaaggtaataacaaaagccacacacgtttcagagaagcatgatttcagctattttccatctgccagaaattggatatgggattagtttctgaggagttctcctacaaggggcagcaaaggagtgaagtggtagttggaagctgaagttgggaaggtatgtctagttatgttacttttttttttttttttgagatggagtttttcactctttgttgctcaggctggagtgcaatggtgcgatctcggctcaccacaacctccgtctcccaggttcaagtgattctcctgcctcagcctcccgagtagctgggattacaggcatgcgccaccatgcccggctaattttgtatttttagtggagacggggtttctccatgttggtcaggctagtcttgaattcccgacctcaggtgatccgcccacctcggccgcccaaagtgctgggattacaggtgtgagccaccatgcccggtcaatgtttcgttttttaagatgggaaaaataacaaacgtttgttaaatgggtgggaatgatccaatgaaaaaagatttaaattggtatgaggggcaaaaaagggaagaatacatggggcaatatatcgagtaggaaagaggagatggaatctagggcaaaatgaggagaggttggtcttaattaggagcaggaacagtttacttataaaaacgggaactttcataagcagagaccatggatacagatacaagtagttgggtagataatggaatagaagtttgtcgatgttctattttattgcttgacttatctgcaagaaaaacaggacaatcagcagagaatgaacatagaaaaggtgttggaggtgggaggagggtaaaggcgggaaagagttgtctaggagagcaggagtatgaataaacttgcaaagtacagtgtgactgtctgtactttacctggcatgatgtttgtccttagtcttctcgagactacaacctggtagagagaaatactgagaataagcacaagcacgtacctggtgaaatcatgaaagtaggtgcagctgactgccccacatcctgcagagattctaaatgggaatcctcacttattcctttttgtgtttgtgcaatttccatgtctttaattggaactggtgttgcctctgtttctgagagtggtggaacatctttggctggagtcacattgttggccagggtcagaaccccatccttagccaggggtgcttctgttttgagggctgggacctgatcctcagtcagggccacctccatttctggaggcagacatacgttcttgatgagaactacttctgtttctggaggtggagtcacatccttgcccagagccatttctgtttctgatagtggagacatgtccttcaacaagcccacttcttttactgtggacggagccacatccttggccggggctatttctgtttctgggagttgagccatgtccttgactggggccacctctgcttctaaaggtagtgctttatccttggtcaagatcacgttggtttccgggggcagtgtcatgtccctggccagggctacctctgtttctgaggacaaagccaccttctcagcagaggatatttctgtggatgatataatgtcattagcctgtgccacctctatttctgagagtaataccaaatccttggctgggactatcttgttttctttgggtggtcccatgtccttggaaggagccaagtccatttttataggagatgccctctctgtttctttcttgttttctttgggtggtcccatgtccttggaaggggctaagtccatttttataggagatgccctctctgtttctttcaacagtgtcacatccttggctggggctacctctgtttctgtgggcagtaccacattcttggctgaagatacatctgtttctgtgggccatctgacatccttaaccagggccacttctttttctgtgggtagttccatgtccttgactagggccatatctgattccatggatggctgcatgtccttggccagtgtcacatctaatttggtgggtgattccatatctttagccaatgccacctcggtttttgtagctagtgccatgtccttggcgagggccatctctgtttctttagatggtgccatgtcagtagtcttcagtcccatcattatttccaatgcttgtgctggtggcctctcttctgatgccatttctatctccttggctagctctaagggaactaaattggaaatttaggacacatcattgtctactcatacctttgcattaaaaatgcttactttcttcaggcatgagagtatttggcttttgtgaccataagactgtacacataactaagaattaatgttaggccgggcacagtggctcacgcctgtaatcccagaactttgggaggccgaggcggatggatcatctgaggtcaggagttcgagaccagcctgacaaacatggtgaaaccctgtctctactaaaaatacagaaattagccatgcagtggcaggcgcctgtaatcccagctacttgggaggctgaagcaggagaattgctagaacccaggaggcggagtttgcaatgaaccgagatcacggcattgcactccagcctgggggacagggcaagagtccgtctcaaaaaaaaaaaaaaaaaaagaagaagaagctaatgtcaagtaacatattctgcctactctttgacagtctcaacacttggaagaataagatgtaaaatactgggaggacaagtagtggaggagaaatggcaaagaagagagaaaacataggcttcaaaaataacacgggcacagaattagtattagaaagataatctgtgggacagcaggtcagtcatgcttcctatcaagaaaaactccagagttctaaatctgtactgaatttttgtttttgttttttgagacacggtctcacgctgttgcccaagctggagtgcagtagcatgatctcggctcccgggttcaagcaattctcctgtctcagcctccctagtagctgggattataggtacacgccaccacgctgagcttatttatttatttatttagctctttcacccaggctggagtgcagtggcgcaatctcggctgacagcaacctctgccttccggtttcaagtgattctcctgcctcagcctccctagtagctgggattacaggcacctgccaccacgcccagctaattttttgtatttttagtagagacggggtttcaccatgttggccaggctggtctcgaactcctgacctcaggtgatctgcccgccttggcctcccaaagtgttgggattacaggcgtgagccaccgtgcctagaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatgaaaaaaatatatatatgttaaaaaatttaaaaaaagtatttatgtgcccgttaaccctaagtgttatagttcaacaatttaattcctccagtggtgatatcactaatataagcaaaacatttgtgattgttctgaaatttttatacctgctgtaagctgctaaaaaatacacctgatgatttatattgattaccaatactgcaaccattaactgataaagggagtctctaatagtttacctgccgttggctgaggaggttctgcaacagcctctggggaaacaaaggactctgagtgtggagagtttaaggcttccacagaccacccctgaggtacaacagctgtgttgcagggagacatacctaatattgaaacacaaacaaatacattttgaaacttagtaaacattggaaacaaaaggtatttgatatatttttgttttgttttgttttgtttgttttttttttgagacagagtttcgctctgttgcccacgcagacagagtgaagtggcgtgatctcggctcactgcaagctccgcttcccgggttcacgccattctcctgcctcagtctcccgagtagctgggactacaggcgcctgccacagctcccggctaattttttgtatttttagtagaggcggggtttcaccatgttagcccggatagtctcgatctcctgacctcttgatccaaccgcctcggcctcccaaagtgctgggattacaggcgtgaaccaccgcgcccggcctaagaggtatttgatatttaaaatcagctgcatatattgccaggaagacacagactaataaaaaacaatgcaaaaaaagttttttttctttttttgagacagagtctcgcactgtcgcctgggctggagtgcaatggcacgatctcggctcgctgcaatctctgcctcccaggttcacgccattctcctgcctcagcctctcaagtagctgggactacaagcacacaccaccacacctggctaatttttttgtatttttaatagagatggggtgtcactatgttggccagattggtctcgaactcctgacctcatgatccacccgccttggcctcccaacgtgctgggattacaggtgtgagacaccgcgcccggccgacaacgcaaacaagttttaaaggaaacactgctgacattcttcaggttttagctagttgttagtaggtggtatagtatatcccagtagtgccattaatcaacattcactggctactttctatataatatataaagggtaatataaagattcaaaatattaatgattgaactctagttccaacaccacaaccaacataatatactatagtaaaaaactgcgagtcttaatttcttcatctgcaaaatgagattaacacctccctttccaacattagaagacaattttattaaaatactttgtagcagttttgttgttgttgttgttgttgttgtttgcccagctaattttcttatttttattatatttatttattaatttttgagatggattcttgctcgttgcccaggctggagtgcaatggcacaatctcagctcactgcaacctccacctcccaggttcaagtgattcttctgactcagcctcctgagtagctgggattataggtgtctgccaccactcccagctaatttttgtatttttagtcgagacagtgtttcaccatgttggccaggctggtctcgaactcctgacctcaggtgatctgcccacctccgtctcccaaagtgctgggattacaggcatgagccaccacactcggcctaatttttctatttttagtagagatggggtttcaccatgttggccaggctggtctcaaactcctgacctcaggtgatctgcccgcctctgcctcccaaagtgctgggattacaggcatgagccattaggcccagcctaatttttgtatttttagtagagacgggatttcaccattttggccaggctggtcttgaactcctggcctcaagtgatccatccgccttggcctcccaaagtgctgggattacgggcgtgtgccactgcacccagatggttttttttttttttttttttttttaagacagggtctcaactctgttgtccaggctggagtacagtggcatgatcatggctcaatgcagcctcgaccttctgggctcaagcaatccttccacctcagcctcttgagtagctgagactacaggcatgtgccaccacgcctggatgaattttaaaattttttgtaggacaggatctccctatgttgcccagattggtttcaaattgctgggctcaagcaatcctgtcacctcagcttcccaaagtgctagggttacaggcatgagccactgtgtctgcctgtaaatgaagaagtagaaaaatgtggctgggtgcaaaggctcacgcctgtaatctcagcactttgggaggctgaagcgggtggatcacttgagcccaggagttcaagaccagcctgggcaacgtgacaaaaccccatctctacaaaaaattagccaggcatagtggtacacacctgtaatcccagctgctcaggagattgaggtgggaggatcacctgaccaggaggccaaggctgcagtgggccgtgatcgcatcactgcactccaacctgggtgacagagtgagaccctgtctcaaaaaaaaggggagatgacagcccaactgtgaatctgtgaattgtctcctttgattaatccaaagagagccttgtcacacccacagcccctaaatctgacttttcttagtggttagcttcaaaggtgatgtgtgaaaggccatgttgattgtttggcattaaacaactaaaggacaccagaatatgccaccccaaaatacgctactttggcataaggacttttttaagctgaaggctattattagcctggagatggcaccataggaatctacacagcaacctttactaactagcttttacctaccatttacctgtctcccacaatttgcggcccctagagactcaaaagtcttttccttcatcttctcacctctcaaaaaaaaaatttgtcattctttattgaagaagctatataaggtggaattctaaagccacctcttgcggagttactcattccctaggtacctctcatgtacatattaaattcacattttaaactttggtctcttttttcttgttaatcttttgtcacagagccctagtcagtgaaccaaagatgagtaaagaaaaaatttttttccttccctacagaataaatccatttgaagaagccataccgtaactgtctttcaagggatcattttgtcctgcaaatattgaagtatcagctgtcgcactggagggaaagaccaaatctgccaggtcatcatcatggtacatcttaaagggatctggaatatagaagaaatccaaaactcattcctggtgaatgcaactagaaagattaatatttctttctttctttcttttttttttttgaggtggagtcttgctctgttgccaaggctggagtgcagtggtgccatcttggttcactgcaacctctacctcccaggttcaagcaattctcctgcctcagcctcttaagtagctgggattacagatgcccgccaccatgcctggctaatttttgtatttttttgtagagacaaggtttctccacgttggccaggctagtctcaaactcctgatctcaagtgatctgcccacctcggcctcccaaagtattaggattacaggcgtgagccaccatgcctggccaatatttcttattatcctatgatgaatatagatgagttgtcaatagtaagtaaaccgaaatcatatgtgactgcacatggtagagaatcaatattcactaattcatttgttatgagttaataataaataatcccttctctaagatttggttatgtacatcagatagccaacaaatgcataaaacaaaaagggcaactaatgctcagctgtataacaaacactctgagaggtgaaagtataaactaaattttcaatatatatttatataacattcattttaagttactttttaaaaagacagagccattaacaagcttaaaaaaaaaaaccaacaagtaatttttcacctcatgtggacatgatgaagaaaactgcatttcaaaactgtctgaatgggacaagataaacaattgttatcctaacagaagaaataaactcttgactcaggagctggcatgaataaaagcactcaaaacatcaggtaaactctttgtgcttttgtacatgaaaaaaaagcagggccgggcatggtggttcatgcctgtaatcccagcactttgggaggccaaggcgggcggatcacgaggtctggagattgagaccatcctggctaatagagtgaaaccccgtctctactaaaaatataaaaaaattagtcaggcgtggtggcacgtgcctgtagtcccagctacccgggaggctgaggcaggaaaatcgcttgaacacgggaggcagaggtggcagtgagccgagatggcgccactgcactccagcctgggtgatagagtgagactgtctcaaaaaaaaaagaaaaaaaagcaaagctgttcaggctaaacaagagttccactttctgaagaggccttcttggaatttattttattatcttaatcatcctgaagacttgttaaaaataaagattgctggttcctgagaatctgcatttccaactagttcctgagtgacactaacacatcactcccttaagacacttcaattgtcagagacagccgcataaaagcccaggccttgagagaatgttcattttcttggctctgaggcagctataccaccctctttttgtaagaaatttcaggattaggggagaccactgcatcgggaagtgtgaacaagcagaaggcaatattgggaaacttgttgaggcttcttcttcagaaaaccatgggagcctggaaaagtggcacacaccccagctacttgagaggctgaggtgggaggatcttcttgagcccaggggttcaaggctgcagtgcactatgatatggcgactgtgaatagtcactgcactcctgtctgggcaacacaccgagaccgcccatctttaaaaacaaaaaacacagcctgctttttgtttaaaaaaaaaaaaaacaaacccttattttcaaaaaacggaaaaattagccaggcatggtagcgcatgcctgcagtcccagctactcggaaggctgaggtgggaggatcacttgagcctggggaggttgagtctgtggtgagccgtggttgtaccactgagctacagcctgggtgacaaagtgaaaccccatctcaaaataaataataaaaacagaacaaaattaagaaaaagaaaagatggggagatagaatatgagagagatgataaacattcattcttcccagttctatatggtttgggatagctcgctgcttgctctgcctctcacacttcccccttgagggaaaaaaggattcttaaagcatcaaacagactaaattctggatggtttgcactttaagatgggagcttgctaaattacttgtaaaaatagatgattcttacagagttctgtcatttagtcattaattttttactgggtgcctaccacatggcagacccagtatgctctaaaaaacccaaagatgtacaaggtcagggatgggaacatttatatatgttcccacaggatatattttggttcaagtcaagggagatctttgcttgataagtatttaagctgagaactaaagaactgagtggttatgaggaggaagacaaaccttttctctctctacattccctctcctctaatcccacagtttaaaattccatctataggttgatgacacctgaatttataattcaagacctctagacctctcaccttattttcagacttttatgtagcatgtttccaaatctactcattatatagtctttccatctctaatggcattctatccttctatgttttttgcaaaaaaccttggagtcatcctggacctcctctttttcacacaccacagccaacccatcagaaaatccattgcccttgaccttcaaaatgtgccccagaacctatttctcccccagctccatgactagggtttctcacaaggttgcagtccagcggttggccaggggctgtggtgatctgaagacctgactggggctgcagaacctgcctgttaagatggcttacgtggccgttgaatggaggcctctgctcctctcccatgtgtgcctctctatatcagctggctttcctcatgattagtaaacacagagtgatcaagatggaagctacgatattttttttttttgagatggagtctcgctctgtcgcccaggctggagtgcagtggcgtgatctcagcttactgcaacctccgcctcccaggttcaagcaattctcctgcctcagcttcccgagtagctgggactacaggcatccgccaccacacctggctaattttttgtatttttaggagagacggggtttcaccatgttggccaggatggtctccatctcttgacctcgtgatccacctgcctcagcctcccaaagtgctgtgattacaggcgtgagccaccgtgcccggctgaagctatgatattttctgtaatttaatcttagaaatgacacactattatttctgccatctattctacaatcacacagaccaaacctagtaccacatgggaggtgactacacaagggtatcaataccaggaggcagggatcattggacgccatcttggcagttgactaccacactcaactttccgctgaggaaattaaactccactgaattttttttcctactcaaaattggtcattcctttgttacccttgctggctcctcttcttcctgatttaaattatttatgtacttatcatttgagcttgggcggtcaaggctgcagtgagcccagactgtgccactgcactccagcctgggcgacagagggagattctgtctcaaaaaaataaaataatgaacaaaatatggtatagccatataatggagtattacgtgtccataaagaaagtactgatacatgccacaaaatgcaggactcctcaaaacagtatgctaagtgaaaaaaagcagtcacaaagaaaccactttatatgattccctttatataaaatgtccaatctaagcaaatttatagagacaaaaagcaaattggtagttgcttagggttgcagtggatagggagatgggggtgatatttaaaaggtacagagtttctttttgtggtaataaaagtgttctaaaattgaatctggttatggttataaccataaatagataaatagataggtaagtagatagagtacaattcagcggaatttttttggagacagagtttcgctcgttgcccaagctggagtacaatggcacgatcttggctcactgcaacctctgcctcccgggctcaagtgattctcctgcctcagcctcccaagtagctggaattacaggcgtgcaccaccatgcctggctatttttttatatttttagtagagatggggtttcaccatgttggccaggctggtctcgaactcctgacctcaggtgatctgcccacctcagcctcccaaagtgctgggattacaggcgtgagccaccacgcccggccaattcagtggaattaagttactctattttatttattttattttattgagacagggtctggctctgtcacccaagctggagttcagtgggacagtctcggctcactgcaacctctgcctcccgggctcaaacgatcctccaacctcagcctcccaagtagctggcattacaggcgcccgccaccatgcccggctgatttttttatttttagtagagacgaggtttcaccatgttggctgggctggcctcgaactcctgacctcaggtgatccgcctgcctcggcctcccaaagtgctgggattacaagtgtgagccaccacgcctggcctaagttactccatttatctactctatctactctacctatctgtctgtctgtctgtctacacatctatcagggacagggtcttgctgtattgcccacgctagagtacagaagcacgatcctaggtaactgcagctttgaagtggcagactcaagtgattcccccaccccagcctcccgagtagctaggactacaggcatgtgctgccacaaccagctaacttttaaaatgttttgtagagacagaatcccattatgttgttcaggctggtctcaaactcttggcctcaagtgatcatcccacctatgcctcacaaagtgctgggattacaggcacaagtcactgaatctggccgaactatatactttaaatgggtaaactgtatggtactgtgaattattggccaggcgcagtggctcacacctgtaatcccagcactttgggaggctgaggtgggcagatcatctgaggtcaggagtttgagatcagcctggccaacatggtgaaacctggtctctactaaaaatacaattagttgggtgtagtgggcacctgtaattccagctatatgggaggctgaggcaggagaatcgcttgaactcaggaggcagaggttgcagtaagctgagattgcgccactgcactccagccagggtgacagagcaagactctgtctcaaaaaaaaaaaaaaaagaattgtatctcaatacagctttttcttcaccctccccccataattactttgtacctaggaaagccgataactgacaaatggtacagaacatcacatactaggttatttgaaacaaacgatgagcatcttataagttagatgtcaaaaaagaagccatatttaagtggaaacataacttgagctctcaatctggctaacagggaagtaccaaagctattcctttaaggctcttttggaactcattcttcctaccaactctagctctgggctactacagataggcttttgtttgtttgtttgtttgtttgtttgtttttgagatggagtttcgctcttgttgcccaggctggggtgcagtggcgcgatctcggctcactgcaacctccgcctcgcaggttcaagcaattctcctgcctcagcctcccgagtagctgggattacagacatatgccactacacctgcctaattttgtatttttagtagagacagcgtttctccatgttggtcaggcttgtctcgaactctcgaactcaggtgatccgcccactttggcctcccaaagtgctgggattacaggcataacccaccgcacctggtctgtttttaattttatagaaagtgggtatgaatcagctttctcttctgtcaaaagaggatacatatatttggcagagttaggtaagaaataccgataatgtgtatataaaggctctagcactgtgcctggcacagaacagcactggtttaacattaccataataattccttctggaagaattaaggttctaaggtactatggatcctctaatcttcagtgtatatgaatttcacataatgtatttaaaataggttttgaagagcagggaactagagggcattaagtgtctcaaaggaaaggataaatgaagaagagaaagggacaaaccaatgctaaggttgtactttgtgatctatacttaagctaaagcattttcatctgaatggtggttgtagctttttcacatttatgtcatagcacacatttagtagtcacgagcaagccaacacttaccagtctggataggatcgaccacttgctcaggttggaaacaaaagttggtatcttctggccagttctggctatttgggtattcctggtaggccattttctcttcaaggaattcagttggagacccttaaaatagagacacaaaacaaaagttacaagatattacagttttctcctccactacagtggaatttctacaaagtattacagctagtacaatataaaaaatcctatctagctagtgtcttacaagaaaacttttttcttttaattgaaagataaaaggagctgggtgcaatggtgcgtctgtagccccatttacttgggagactgagagaggattacctgaacccaggagtttgaggctgtagtgcactatgatcacacctgtgaacagctactgcactccaacctgggcaacatagcaagactctgtcactaaaaaaaattttagatagaaggaaataaagtaggtcattaaggttaaaaaaacactacagagtgacttctaggttatgcaggcacgaagagggtagtgatttctccacatgaaagaacaaggataaaactgtcaaaagcaacaatttcagggagctggaattaaaaaaaaaaaaagccagcctaaataagtggaaaggtataacatgctcaggaatgaaagattcaatactgttaagatggcaatcctgaaaatgaccaatatattgaagaaagtacaaaataagctcattccataatttatataaaaatgcaaaaaacctagaaaagccaaaacaattttgaagaaaaacagttgaagggcttacataacctgatttcaaaagttattataaatgtaccaactcaggctgggagaagtggctcaccacctgtaatcccaacactttgggaggctgaggcaggcagctcactttgaggtcaggagttcgagaccagcctgaccaacatggtgaaaccctgtctctagcaaaaatacaaaaattagctgggcatggtgatgcatgcctgtaattctggctactcaggaggctgaggcacgagaatcacttgaacctgggagtgggaaggttgcagtgagccaagattgcgccactgcactacagcctgggtgacagagcaagactgtaccaactcagcatggtattgacaacgtggtattggaacagaacaggttcagaacgtggtactggaacagaacaggttcagaaagaaacatacaaagttagggtcaactggctatctacaaacataatataattcaacataattatattcaacccagaaacaaattttttttcaacaaatgatacagaaacaattggacactgaccacataccatatgcaaaagttaactccaaacagatcaaagacctaacgtagctcacttgctaacttattatgcaaaaaaaaaaaaaaaaaaaaaaaaaaaaaagacaagacaaagacctaatgtaagagttaaaactaaaaaaacttataaacaggaaaaaatctttgtgactttggattaggcaaagatttcttagacatgtcaccaaaagcactatctgtaagagacaaaatatataaatgggacaccatgaaaatttaaaacttttgcttttcaaagatgctattaaacggccaggcatggtggctcatgcctgtaatccctgcactttgggaggccgaggcaggcggatcacctgaagttaggaattcaagaccagcctggccaactgggtgacaccccatctctactaaaaaatacaaaaattagctgggcctggtggcctgtgcctgcagtcccagctactcaggaggctgaggcaggataatcacctgagcctgggaggcgaaggttgcagtgagctgacattgtgccactgtactgcagcctggggcaacagagtgagactgcgtctcaaaaaacaaaaccaaacaaaaaaacaaaagacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaacaaacaaacaaacaaaaaaaacaaaagacaacaacaaaggtactattaaagaaaatgaaaagagaagtcatagacttcgagaaatatctgcaaatcataaatctgataaaagatttgtatgtagaagagattataatctcttacaatacaattataagataaacaactcaatttaaaacttgatggccagctgcagcggctcatgcctgtaatcccagcactttgggaggccaaggtgggcggatcacaaggtcaggaaatcgagaccatcctggctaacacagtgaaaccctgtctactacaaatacaaaaaaaaattagccgggcatggtggaggatgcctgtagtcccagctactcaggaggctgaggcaggagaatggcgtgaacctggtaggcagagcttgcagtgagcggagatcacgccactgcactccggcctgggtgacagagcgagactctgtctaaaaaaaaaaaaaaaaaaattggctaaatatttcaatagacattttaccaaagaaaatatataatgcgtaatatgcacatgaatgaagctcatcagtccttagggaaatgcaaattaaaactacaatgaactcctactacaaaaccactaaaatggctgttatcaggccaggcacaatggttcatgcctgtaatcccagtacttcgggaagctgaggcaagaaggtcacctgagcccaggagtttgagaccagcctgggcaacatagtgagaccctgtctctacaaaaacatacaaaaaaaaaattagccaagcatggtgacgagtgcctttagtttcagctactcaggatgctaaagcaggaagattgcttgagcctgggaagtcgaggctgcagtcacctgtgatcacactactgccttggtgacagaaaaaggccctattttttaaaaaaggctgtacaaaaagactgacaggagcaattttgagaatgtgtaaaatggtagtttggtggtttccttttatttacttatttttgtttttctcaaagttgctctttttttgttgttgagacagggtcttgctctgtcatccaggctggaatgcagcggtgtggatcatggctgactgcagcctcaacttcccaagctcaagcaatcctctcacctcggcctcccaagtagctacaaatataggcacttgccaccacacctgcctaatttaaacaaaatttttttttttttttttttgtagagacagggtctcattatgttgcccaagctggtctccaacttctgggctcaagcagttctctgatctcaacctcctcaagtcctaggattacaggtttgagccactgtgcctggctccatctgtatttttaaagactagtcaagtacaacagtgagaagcagggaaagagtggaacgtggagttcaatctgtaactgactgaacaattgagataactcactacctttggaccagcctctttttattttttaaataacagttttatcgagtataattcacaaaattcactcttttaaagtcgagttcaaaggttttttagcatatacacagttatacaaccatcaccactatctaacttcagaacattttcttcactccaaaaaagaaatcccatatcttttctcctttcccactttcccctacccctcggtaaccactcgtctactttttgttcctaaggatttgcctaatctagatatttcatataaatgaagtcacacaatatgtcatcttttgtgactgacctctttcatttagcacaatgttttcaaggttcatccatgctgtagtatggtaactgaactttattcctttttatagccaaataacattccactgtgtagatccaccacactttgtttatccattaatcagctgacatttggttgtttctactttttggatattgtgaataatgctgctatgaacattcacgtacaggtttttgtgggaacgtgtttcaattatctttgatatatccctaggagtagaactgctgggtcataaagcaactttatgtttaatattttgagacactgccaaactgtttccaaaatggctgcgtcattttacaatcccaataacaatacatgaggactccagtttcttcacatcttcaccaacatgttgttatctttttttatcgtagtcaccctagatgtggtaagaagtagcatcttattgtggttttgatttggactgctctaatgactaatgatgttgagcattttttcatgtgttcatctggcatttgtatgttttctttggagacgtgaaatgagtggggtctcattatgttgcccagactattcgggtgcagcggctgttcacaggtgcaatcatactgccttgcagcctcaaactcctgggctcaagtaatcctcttgcctctgcaagagacacctacagctgagaccacaggtgtacaccaccatgcttggctatctttttttgtttttatttttgagacagtcctgctctgttgctcaggctggagtgcagtggcacgatcacagctcactgcaaccttaaactcctgggctcaagagatcttcctgcctcagcctcaagagtagctgggactacaggtgcatgccaccacacctggctaatttttttttaatttttgtagagaagaatctcaaaagcattatgctaagtgaggaaatcaagataccaaagaatatatattgtatgattccatttatatgaaatttctagaacatacagaactataacaggaagcagatcaatggtcacctgaaactgtaggtcagaaaagggactggctttgtaaatgggctcaagggaacttttagggtaataaaaaaatgttctaacgatggattacactgatggttgcacaactccataatattactaagaatcatttcgactccgtaattttactaagaatcatttacttccacacttacaacaggtaaatttttgggtatgtaaattacacctcaataaagtttttttctttcttttttttgagacagggtctcactctgtcacccaagctggagtgcggtagtacgatcatagctcactgcagcctcgacctccctgactcaagcaatcctctcacctcagcctgccaagtagctgggactactggcatatgccatcctgcccagctttttttttttttttttgagacagagtcttgctctgtcacccaggctggagtgcagtggcgcgatctgggctcactgcaagatccgcctcccagattcacgccattctcctgcctcagcctcccaagcagctgggactacaggcgcctgccaccacgcccggctaattttttgtatttttagtagagacagggtttcaccatgttggccaggctggtctcaaactcctcaacccaagtgatctgcctgcctcagcctcccaaagtgctgggatgacaggcatgtgtcactgcacctggccccaaaagccaactttaaatggcatttcaacacaagtaggttccccagagctgaatgtggtgaaattgggttaattatgtagtttaattttctgtactctatgtatgtattcatcaccatttcagtagatatgtaaggccaattttacataggtcacacatacttgtttttaaacactgctggagaagaaatctcaaggctgaccgaagcaacagactcaggcactgggtaaagagagggacaggacatcaagagctaatctactggtggtgaccaggcagcactgaatcaacagcaccacaacatattaaataatttttttaaaaaagtgattagggttttgaaccctacttttccccagtcaaatttctaccctttcaataccttttagtatctgctgtatactgatggcatagttttgagacagcgtctccttttgtctcccaggctggaatccagtgacttgatctcagctcaccctaaactccgtctcccaggctcaaattatcctctcacctcagcttcttgagtactgggactacaagcacgtgccatcacgctcggctaattattgtatttttggtagagacaggatttcaccatgttacctaggctggtcttgaacttctgggctcaaggagtccacccatcttggcctcccaaagtgctgggattacaggccaccgtgcctggcccagtctgctttcttataaacaatattagtgcggctcataatttacatattactaacaaacgaatcagtgactccttctatttcacaccctcagctctttccttgtttttttgtttttttcccccagtggtaacctcagaactttaaagtgaaaggaacctagaggatcacctaatccaaacctctgaagtttaaaccatgccacatttgtccagataattcatttaccaatttaagcacatactgtcaatcgctactccaggcattagtgattcagcagtaaaccaaatggtgaaatgtcctgctctcatggaacttagatcaccaccatcaccaccctatgcttaggcactacgaaaacacagaagcaagtattagcctagttgagagtttaagacatgcccaatgatgcaaacctctgcaagctttagttttcataactaatacctacttcataaggctaagatatgtgaagtgcttagaaaattatgagaaacatgctaaattattgctaatcctataataaccattatggtttatgtaggacaagtgtctacaatgcagtaagtgctacttataggagtttaaagaacagtcacataacacagtcgtgggatgatctaggatcttcctgtaggagactagaacttaattgaatctaggaagatagaaggatgtaattaaatgaagctgggaaacagagaaagagacaaagtggggaagacacacagcaagcaaaatagaagttagggccatgggcaagaatgggaaaaccaagagcatatcactttggatgaaacacatttatgaaggacagcagttcttcataaacggcagctagagtttcaaaggccaaatagaaacttaagatttgtctgcctgaatgccttctaaagggaaacccacccctaggaaccatcccattcctctatttggtcctggtgttttgctttccccaccgaagaagtagacttgtgattcaagcaggcccaaagcccttttggagaaacctgatatacagacattttaagatattgaaccataataatatacctgagctggccaggcgtggtggctcacacctgtaatcccagcactttgagaggctgagacgggtggatcacctaaggtcaggagttcgagaccagcctgatcaatatggtgaaaccccatctctactaaaaatacaaaaattagccgggggtgtggtgacgtatgtctgtagtcccagctactcaggaggctgagacaggagaattgcttgaacccgggaggcagaggctgcagtgagccgagatcacacaactgcactccagctgcagtgacgtagtgagacttagtctccaaaaaaaaaaaaaaaaaatattaggaatatacctcaaaaaaattaagaattttatataagaatataaaattaagaatatagctgccagtggccatctttctcaaccctgaaagacactgcctaagaatgaagccaaagaaggtgtagggaggaaagaaggggagaaagaggagggtgggagagagacaaagaaggagaagaaggagagaaagaggccaggcatggtggctcacacctgtaatcctagcactttgagaggctgaggtggtggatcacttgaggccagaagtttggcaccagcccgaccaacgtggtgaaaacccgtctctactaagaaaacaaaaaattagccgggtgtggtggtaggcacctgtaatcccagctactcgggaggctgaggcagaattgcttgaacctgggaggcagaggttgcagtgacccgagatcacatcactgtactctagcctgggcaacagagcaaaactctgtcttaaaaaaaaagaaaagaaaaaagggggaggagaaaggagagacttatggatcaggtattattctaaaacccttatatgttaaaaaaaaaaaatctagctacaagcacgcaacaaaatatacaaatatacaatgcctagttcttataatggcacacgtaacattgaggaaatctctaaaaacaaagcttcttcacaggacagaaaagcaatctaaaccaaaaagagatatgctaaagaaggaaaacagaactagaaaacagaatcaggagcccaggcacggtggctggcgcctgtaatcccaacactttgggaagccaaggtaggcagatcacctgaggtcaagagttcaagaccagcctggccaacatggagaaaccccgtctcaactaaaaatataaaattagccaggcatggtagcgggctcctgtaatcccagctactcgggaggctgaggcaagagaactgcttgaacccgggaggtggaggttgcagtgagccaagatcgcgccactgcactccggcttgggtgacaagagcgaaactccgtctcaaaaaaaaaaaaaaaaagaaaagaaagaaaacagaatcaggagacccaggttctaatcttgactctgccacttaactttgggtgtgaccttaagactgttagagctacactactcatccagaattaaaaaaaaaaattgtgctacataatttctgaagcccattttaattttaaaattaattctgagacttttgacttatccattcatctttataattctcaaaaatctggtaaaacataacttacaaataagactcagcagttattagacagatgaaatacttggtcatttaagtagatgaaagtactcattacttgtctaagccagaaaaatgacgatgaattaaagaacaaaccacagcatcctcgggaaggttcacaagtggcatatacactgagcagaggggaagaaaaggtgatgaaacttggataaacgcctttttaaattagtaaaaatattaaaagcaatatgttttttcataggattaatatatttgtcttagttcttgaatcacaaaacacaaatgtaataaaacaaccccattctggattactgcagtgaaattaatcagaaaattataggagaaagatgtttctgatgttctcaggttgaaggtaggaatcaatctcagaacctttggctaccttcaagaacagcttttcctttttcttcttcttttttttttttttttttttttgagacgaagtctcactcttgtcccccaggctggagcgcgatagcacaatctcagctcactgcaacctctgcctcccgggttcaagcgattctcctgcctcagcctcctgagtagctgggattacaggcgcctgccaccatgcccggctaatttttgtatttttagtagagacgaggtttcaccatgttggccaggatggtctcgaactcctgacctcaggtgatccgcccgcctcagtctcccaaagtgctgggattacaggcatgaaccactgcacccagccatttttcttcttttattattattattaaatattctaaaaaatctatagagggaaaggagggagagaacagctgggcaccagcagacatatttgagttcttacttttattttattgagacaagatctctgctgggtgtggtggctcatgcctgtaatcccagcactttgggaaggcagaggcaggcagatcacttgaggtcaggagttagagaccagcctggccaacatgatgaaacgctgtctctactaaaaatacaaaaattagccacgcatggtggcgcacacctgtaatcctactcgggaggctgagacaggagaattgtttgaacctgggaggtggaggttgcagtgaaccgagactgtgccactgcacccagcctgggcgacagagcgagattctgtctcaaaggaaaaaaagaaaaaagggaattgttaattgagacaaggtctgactgtctcccaggtatagtggcgcaatcacagctcactgcggcctcaacttcctgggctcaagcaatcctcccctctcagcttctccagtagctaaggacacagatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaaaacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtctcctccctgatccaattccaaagccaccacttgggcctcatagcttccacagaacctctctgatgactttaatgctcattttccactacttagctcttttaccattcactgttactaggaaagaatttagtccttaagcacatgttttcctgttagtctttttttaaaaaattaaaaagcctttaagtattctatttatcattaaaattttcattattttacatgttagtaagtgaactcattaatgtttaaaaagaaaatactgtgcttttactacttttatttcctcacaatgcctagctaactgcatgagacagaatagtattcaataaataagttgctatcaaattatcacaagatcattatttgggctaaatgatgtaagttaaattcacattatacaccaaacttcttggaaagtgatttgcatttattataaagagcataaggttggtgacataatgtttttttttaaaaaagcataaggaattccaaaataatttaaacaatagcctatcatttctaagatagacattaaaaactctgattctgcttatatttcttactcatggtaagaaactgtaaagaaatagttttttttttttttttaaacaaccacctcttgatcaaaaaataagtttttaatcagagaaatgggtacattttcctcacccctcctggagaaggagcatgaaagtctgttttttgttgttgttgtttttttcatttttttaaaaatttttttgaggtggagtctcactctgttgcctaggctggagtgcagtggcatgatctccactcactgcaacctcccaggttcaagcaattctcctgcctcagcctctcgagtagctgggattacagatgtgcaccaccatgcctggctaatttttgtacttttagtggagacgaggtttcaccatgttggtcaggctggtctcaaactcctgacctcaggtgagccacccgccttggcctcccaaaatgctgcaattataggtgtgagccaccacacctggcccaaatctggttttaagatgcagaattttgctggttattcccttccacagggtgcagcacagcctggagcagctatctcaacagcaaagttcagaatcaccagtcccccgccaccattattattaaggagcatgtttgaccagaggctcactcccacatctttattcaatactgctgacctagattttgttcttaaaactacacagcagaagcaggcaaactcccctgtagaaacaacagccttcagaataaattttttagcatacttgcaatctactcagagagtctatttcagtaaaactatggaaaatgaaattctaaacaagaagcaatttacataatgcagtagaaaaaatacttaccactaccactggccatccctagagactttgattctcctataaaagtagaatggggaaggacaggggacagttttctatctctgtgaaattgaaggcatttaacagaaaaggcatatggctaaacacttaaagtactaattaaacaagtagcatatctacatatcaaaactagactaattctgtcacatatgatccattccaagtgcaagatagactaatggattttaaataacagtacaaaaagttcattgatatggtttcagattccccattgcaaacaacctttaagaaactaccacttggctaggtgcagtagttcacccctgtaaaccacagcactttgggaggctgaggtgggagaactgcttgagaccaggaatatttttttcatttttggagacagagttttgctcttgctgcccaggctggagtgcaatggtgcaatctcggctcactgtaacctctacctcccgggttcaagcaactctcctgcctcagcctcccaggtagctgggattacaggcagccaccaccacacttggctaattttttgtatttttagtagagacggggttttaccatgctggccaagctggtctcaaactcctgatctcaggtgatccacccacctcggcctcccaaagtcctgggattacagcgcctggccagagcccaggaatttgagatcagcctgggcaacataatgagaccctatctctaccaaaaaaaaaaaaaaaaaaaaaaaaaaaggaagaagaagaagaaaagaaactaccatttgtgaagttttgatgtcaaatcaaatacccatagttacctggaaaaaaaactgtcaaaatattcctcctcctaactacatatttgtgtgaaatggattttcttcatatactgcaacccaaacaacatattgtgacagactgaatgcagaggcagatataaaaatacagctgtgttctattaagacagacattaaaaagatttttaaaagcgaaaccatggctgggctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccctctccccattccctgcagaaagtcaagaaatccaagacaaagttcaggcttcattatgcttttgggatagaagcttagccatgtgagaaatgaaaaaatacacaacacagtatctcattaagagctaaacttaatcataaagacgttaaaatggcataacaataaaaattaagaaaaattaatgctggcaaaggtgcttcacagaaaagaaaggggaaaatgtctgaatgtggtattttcatttactactgacagttttttttaaattaaaaacttttttttctatttatttttagagatggggtctcactttgttgcctaggctggagtgcagtagctattcacaggcataattatagctcactgcagccttgactgagctcctggccccaagtgattctcccacatcagcttcccatgtagcagggactacaggtacatgccactgtgccctgacaatcaccactgtttttgttttttgttttttgcttttttcatgcacacagggataccagttactgttgacattgtaagtaacacatgtgagaacatcttagattattagatcaaacaaaggtgacaaggaaaatacgtgtatattcatatacatacatatcttacagaatgctaaaatagttgtggtaaaatcgtattgattgttgaatctggaaaaatgtataaagttctttcaacttttctataaatttgaaattatttcaaaataagctgggcatggcggctcacacctgtaatcatcgcaatttgggaggtggaggcaggaggatcgcctgagcccaggcattggagaccagcttgggcaatgtagcaagaccccaacctctacaaaaaaaatttaaaaaattagccaggcacggtagtgcacacctgtcgtcccagttactttggaggctgaggtgggaggattgcttgagccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccagatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaacccatctcaattaaaaaaacaaaaataaattaatgatatttgacatccctacaatggttggaagactctgagtttagccctctagcaatatttgaaaacaccaaggcatttgaaggaaatctccagcaggaaggagataactttaagatcacatagcacacttgttttgcttcaaccagaaattctgctggatgtgtctcagagtggccacaggtgaaggatgctaccctgagaccacaatacaggctaagttggcagtagctgagctgtcaactcagaatactgaatagtttcagtattctacctcctacaacacttgatttattatcatactgaatgtacttgttcctataaacacacctctctacacaacttcctataaaaacatgtgtccctggcaaggcgtggtggctcacgcctgtaatctcagcactttgggaggctgaggcaggtggatcacaaggtcaggagatcaagaacagcctgatcaacatggtgaaaccctgtctctactaaaaatacaaaaattagctgggtgtggtggcacacgcctgtaatcccagctaatcaggaggctgaggcagaagaatggcttgaacctgggaggcggaggttgcagtgagccaagatcacgtcactgcactccagcctgggcgagagagcaaaactctgtctcaaaaacaaaaacaaaaacaaaatgtgtccccatgcaacttcctttctcattctccacagtctgttatacatactttcttttccagctcactccatccaaaatatagtattttactttatagaaaatgatattatatgactgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttggagttaggtcatatcctgctaacaacagtcttattgatcagttgtaaccccatatgttgtgtttttattcttacttataagaggtaaatttttgtaacagtcacatcctttaaatgatacttcattatattcaaattctatatgtagacaatcttcaatgcccacttccatcaggatagctggcaagttggtgaacagtaagatcacattctttttaccaagtctgtcagtcttcttactactaacacttcaatacatcaagaggacattagcaccaatgtaagattctcatgacttttcaacatgtataaattccaaatgacaacttctgagtcagctctccaggtaaggctagttctttcactaggtttacaaactcttgaatattactcttatcatagaaaagttcaatttgacgtacaaattcaattctaatgttgtggtgctctagctctttctagactctttcacctttcctgaaacagattctccatcatagaggagatggtgtttttctacttcgccattttcagttttcacttctgccattttctttgtttccttatcattaaggacaatatcaatctcacaaatcagaccaaaaaagcctccaaaaaacctcactgtcagtgatactgccacatcccccaatacttcactcctcttccctcagaactccaagcccctggctcccatcacatgaccttggccctctgaagctggaacttctatttgaggactgataaacagccagcaggccaagcacagtggctcacacctataatcccaggacattgggaggctgaggccggaggattgcttgagctcaggagtttgagactagcctgggcaacacagcaaaaccctgattctattaaaacaaacaaacaaacaaaaatatagccagcaatggatacaatgactatggggctgagcatgtcctcattcctcattttagaacaagggtgagagtttcaccctctgacatagctgtatcttgttaggtagaaacataagagtttcattgttatatgggagctcaaatgtgtgtaaagtgcatatggaagctaagtagccaaaataataggctatgcaagtaatcaatatattgcctctcaattccaaatctacctttcattgccctgcctgtaataatgtaaacatttcttcctagagagcgggcatgatgacactaagcttagtagagggcatggaaggaaagggtttctcttcctggttctagtgtgcttttgcatcttcttacttccatggtgctctgctggtgtgcagaacaccccatggtgctcatcccaacaagctttagtgggcattctcatggacatcttcccaggcaagttccaccagtgcctcaaacaggcttgctggtgatgccgcagcacccccaagtacagcttcctgcttaactacctttgaggtagaagaccagcaggacttaatttcctgtcgcaccctgctgattggaacaagatctggctgaaaccagcagatgctgacaaaagtaacctcgagttgccctcagggtttattagcataaagacactcctaccagtgccatggcagtttacaaatgccatggcaacagcctagaagttaccttatctgattcccagaaacttccagccccttttccagaaagttctaaataacctgcctcttaattagcatgtaattaataacagatataaacagctagctagcagctcacagacaccgattctgggcacactgcctatgggttagccctgctcagcaagaagcagcactggttcaataaaagtttctttctctcactactggctcacccttaaattctttcctggcaaagccaagaaccctcctgggttaagccccagtctgggggcttgtttgccccacatcaccctgacctgcagcaactcagcaaacatctttactaccaaatggagacttcctccaagatatgcaatcagctttgggggcagggtgggggaggggcgcatacttttccaaatttgttatttctttgtgtactctgccccagccctaagggtagtgactattccctatatctgtcattcctgtattctttagagttctctttacccctatagtaaattctctgttcaatttatggtgtagcttctgtctcctgaatagactctgatccaaatattggccattaaaaacagcataaatctacataataggaaagagtggaagaaaaaatgaaagatgtttaacccaaagaaaataaatcagaaggcaaatgttaatctctaaatgtctaaaaagctatcacctaccgcagaacatactgtatctctgttgctcagcactaacagcagcagcagaaacagcagaatgcctgttcgttttacacagaaaaactgaagaccagaaatattaatttgttaaatagaaagcaaaatccttcaatgaagacctctaaggagtctaatgttaatacttaagtttacagttgacatagttttgcatcttctcatttcattttaaattgctgaaaacccactggagggccaggcttgccagttttttgcagtgagagtcctaagttaattttttcacaagaaacaaaacaaaaaaactcttctttcagtctgcctggagctcacttttgaagtttcacctccagttttgtcctctagaaacagagcatttctgcttcacaatggaccaatatgctccagttacatccgattaaaatactgttacacaaccaattaagtaggaaaaggggctgatggtcaaacagaatgatttaacaaaagtatataatgggttgaactgtaagaactttctatgtggacattaatcatcattctaatatcatcttacatttaaatattaaccccttcaacgaggtttcaaagcactgaaaataatttctgtcacttcaggcaaacaactatttttatagagctctccttttacacagcaggaatcttagcctcaaagagggcaaacaacttgcctaagaaatcaaagctagtaggtgctctatccacagcttcctcaaaatttaaacaaattcatgacagataacatatttccagaaagatgcgtaccaataacctggcaagaattattacgattgtatctggtcttgtttttaagtttcttttcccatgtgaggccagaaacaaatagatattaaagattattcattcaatagctacagaggatctactatccaccagacagtgttctaggtgctgggccacagcagtgaccaaaacaaaagccctgtccctctcataaaatttgtttctataatatcttcttctggtggggaaaggcagatgagataagtaaactatacaaattattagaaagtgacatgacaaaagccacgaagaaaattcaagtagaacagtgggacgaaaaaatagaaggggtgcaatttttaaaaagatagtcgagaagtactcattgagaaagtgaagagtcaatcatgaatatatcaaagggaagaacattccaggcagagaaaactgctagtgctcagagctcaaggcagatgcccacctggcttgttcaaggaacagtagcaagaacaccatgaagcaaagtaagtaaaggggtaactaagaaaagatctggtcagaaagatgacaacgacatcatagggccttgtggtatttcataaggactttggcttttactttgagatgggcaaccactggagggttctgtgcaaaagaacagcatgatcaatgtacaggaccactgtagatgtttttaagaatatgctgcagggagcaagcaaatggaagcagagagactaatttgggaagttattacagtagccaaggttaatgatggtggtccaatcagggagagagcagtggaggtggtgagatgtggtcaggttccaaatatctttttctgacaaactgggtgtggggtgtgagaggagcagaagaggatagggaaaccaaatgtttagccttaacaaccaggacagaatttccatttaaggagatggggaggcaggtggtttttttcttctttttcttctctgttttgattttggggtggggcaatcatgaattcagtttagaacatttcaaatttgagatatcaattctacatccaaatggagatttcaagctcgaatttcaaatttccttagttctcactcaaccccctcatggaatttaaccaatattgtatctgttcttacaaaatgttccccataactgcttagcatttaagcaatgttgacatatttgtgtatttctctctgcaactggacaaaccagaacaaacgtacaaaatacctaacatataaagcatccctttaattctgaagagatctgtgatatgatggttaatttgaaatttttttccctttaaatatgagctgcatttgtttatttctacgattttaacgatttttaagtgtacagttcagtggtattaagtacattcacactgttgtgcaatcatcaccaccatccatctccagaactttttcatcttgcaaatcagaaactttgtacccattaagcaacaccaaacacatccattccccgcctctcccagcccctgggaaccaccattctactttgtttctgtaaatttgactacttaaggtaatttatataaatggagtatatttatatttgtttctgtaaatttgactactttaggtaccgcatataaatttgtatttttgtgactggcttttttcacttagcatagtgtcttcaaggtttattcatgttgtaccatatcagaatttccttcctttttaaggctaaataacgttccattatatgaatgtaccacatttttgtttattcattccatgtgttgatgggacatctgggttgcttccatcttttggccactgtgaataatgctgctacaaacatgagtgtacaaatatctgttcaagtccctgattccaattcctttgggcatatatccagaagttgggttgctggatcttacaataattctgtttttaattttttgaggagccaccatactattttccatagcactttcattttacattcctatcagcagtacacaagggttctaatttttccacatcctcgtaaacacttgttaatttctgttcttgttttcatactagccatcctaatgagtatgaagtgatatttcattgtggttttgatttgcatttctctaatgattaatgatgctgagcatcttttcatgtatttcttggcaatttttgtatcttttatgaagaaatgtttcttcaagtcctttgcccatatttttaatttttttttgttgagctctagaagttatttacatattctggatattaactcctgagaagatataagatttgcaaatattttgcctccatgggttgccttttcactctacagagatagacaaaaattttcaattttcatatagcctaatttatctgttttttcttttgtcgtctgtgtttttggtgtatatccaagaaaacactgccaaatccaatgtcatgaagatttccctctatgttttcttctaagaaatgtatagccttggtgctttgtttaggtctttgatccattttaagttaatttttgaatataagataatggtcccaacttaaaaaaaagagagggagagacaggatttctctctgtctcccagggtgaatgcagcggtgtactttaccatagctcactgcagccttgaactcctcagctcaaaggatcctcctgcctcagtttcctgagtagctgggactacaggcccacactacctttttttttttttttttttttttttttttttttttttgagacagagtcttgctctgttgcccaggctgaagtgcagtggcgcaatcttggcttatgtaagctctgcctcctaggttcatgccattctcctgcctcagcctcctgagtagctgggactacaggcgcctgccaccatgcccggctaattttttgtattttttagtagagacggggtttcaccatgttagccaggatggtctcgatctcctgacctcatgatctgccctcctgggactcccaaagtgttgggattacaggtgtgagccaccgcacctggccaatttttttttcttttaagagatgaggtcttcctatagtgcctaggctggtcttgaactccttgcctcaagcaatcctctcacttggcctcccaaagcgctgggattattggcataaaccactgttcccagcaggatccaacttttttatgtggatatccagttttcccctcatcatttattgaaaacaccatcctttcccattgaatggtcctggtaccgttgtctaaaatcatcttaccatgtataaaagagtttatttctgggctttccattccgttccttgatctatatgtctccctttaagtcaataccacacagttttgattattatagcatttcagtaagttttgaaaatcaacaaatgagacttccaactttgttctttttcaagattgttttgtctattcaggagggctccttgagattccgaatggatttttctatttctgcaaaaaacattgttcagattttgaggaaaaaatatcatcttttaaaaacacatttagggccgggtgcagtggctcatgcctgtaatcccagcactttgggaggccgaggcgggcagatgacctgaggtcaggagtttgagaccagcctgaccaacatggagaaaccccatctctactaaaaatacaaaattagctgggcgtggtggcacatgcctgtaatcccatctacttggaaggctgaggcaggagaattgcttgaacccggaggcggaggttgcagtgagccatgaacgggtcactgcactccagcctgggcgacagagcgagactccgtcacaaaaaacaaaacaaaacaaaacaaaaaacacatttaggctgggtgcagtggcttacgcctgcaatcccaacactttgggaggctgagatgggcagatcactgaggtcaggagtttgagaccagcctggccaacatggtaaaatgctgtttctactgaaaatacaaaaattagctgggcatggcggcaggcgcctgtaatctcggctactcggcagggtgaggcaagagaatcacctgaacctggaaggtggaggctgcagtgagccaagatcatgccactgcattccagcctgtgcaacaaagcaagactccttctcaaaaataataaaataaaatacacatttaggccgggcacagtgactcacacctgtaatcccagtactttgggaggccgaggtgggaagaacacttgaagcaaagagttcaagcccatcctgtgcaaaaaagcaagaccctgtctctacaaaagattttaaaaattagccaggcatggtggtgtgcacctgtagtcctagctacttgggaaactgaggcgggaggattacttgaacccagagttccaggctgctatgatcacaccactgcactccagcctgggtgacagagtaagaccctgcctcaaaacaaaaaaacactttaaatcgtcctaccagcgaccgacatttcaactgctgcttctgaggctcatagttgtagcgatcatttgtgtgtatctttcttatccacaaccgtagcatttttcacaaggaatttatccttgagaaatgtaaaaagcatgtaaaatttaaagctaacagaacttgagcaaacaatagactactcaataataattgttggatactgcaatacctcactttcactaatggatagaacaacaagacagaataccaacgaggaaagagaagacctatataacactatacaccaactacatctaatggacatcttacagaacattccacccgcatcaagagccgaatatacattcttcttcaggacagaccatatgttaggccagaaaacaagcctccatatattgaaagggattgaaagaataccaattatgttctccaaccacaatgggatgaaattagaaagtaaacagaagattggggaatgcacaaatatgcagaaattaacacactcctaaataatcaacacgtcaaagaaatcccaaaagaaattagaaaatactttcagatgaatgaaaatgaaaacacaacatatcaaatcttaagaggtacagctaaaacagtggtaagagggaaatttatagccataaacacctatattaaaagaataaaataaaataaaaatcaccaatcactaacataaccttctaccaaaagaaactagaaaaatagcaaactaaactcaaatgaggcagaaggaaggaaataaaaaagattaaagtggaaataaaggaaacagaggagagaaaatagagaaaactcaccaaaactgaaagttggttctttcaaaagatgaaaaaaattgacaaacttttaactacatttatgaagaaaaaaggagagaggattcaaactactaaaaccagaaatgaaaaggagatatcactatgaatcttacaggaataaaaaaggtttataagggaatactaagaactgtaggcaaacaaattatataacctagatgaaatgaacaaatttctagaaacataaaaactactaaaactaactaaagaaaaaaacgtttgggtggaaaattccaaaactaacatctgtggctatctctatagtttctaacaatgcagctcaagaattagcacctggctaggtgcagtggctcacgcctgtaatcccagcactttgggaggcgaacatgggtggatcacctgaggtcaggagctcaagaacagcctggccaacatgctgaaaccccatctctactaaaaacacaaaaattagccagacatggtggtgggagcctgtaaccccagctactcgggaggctgaggcaagagaatcacaagccctggaggcagaggttgcagtgagccaagatcacgccattgcactccagcctgggcaataagagcaaaactctgtctcgcggggcgcggggagagaaaaaaaaaaaaggattagtaccataatagatggagttccttcaaatttcctctacagagttgaaggatctcatcctctatggtaaggcataagcagacaaatcttatgttaagagaatcttgctttgaagtaacctcttggttagacacttcttgtgcccccacctcacactctgttaagttcactatttattctagctattgctacagcatccagctgcacataggtgtgatttgacagcactttgtatcaaccaaaccagagttttctgccctacaacttctctgacaccaagagacaagacatctgcatcctggcaccacacatgtgcaaatccagaagtacaagagtgttaggcccaggaggcagagcttgcagtgggccgagatcgcaccactgcactccagcctgggcgacagagcaagactctgtctcaaaaaaaaaaaaaagagtcttaagcaatgagagatggtaaatggtgaataaatgttatccacttctataaccaagatactcaggtagtgaacactgagaggcattctatacaggtcctcaaaagaccccaaaagacttaagcccactttgcccacagcagtgactaggtcagtagtcatacttcactgtattcttttcctctaatttcacttttcccagtatcccactcttgtgccctggggccacttcccaaaataaactacctacatgcaaagcccttgcctcaatatggattttctctcagtaactagaacttaagataggttttttaaaaagtctttaaaagctgggcatggtggctcatgcctgtaatcccagcactttgggaggccgaggtgggtggatcacctgaggttgggagttcgagaccagcctgaccaacatggagaaaccccgtctctactaaaaatacaaaattagccaggtatggtggcgtgtgcctgtaatcccagctacttgggaggctgaggcaggagaattgcttgaacccaggaggtggaggttgtggtgagctgagattgtgccattgcactgcgctccagcctggggaacaagagcaaaactccatctcaaaaaacaagaacaaaaaaacccaaaaaacatcagaaggctgggcgtggtggctcacacctacaatcccagcactttgggaggcagaggcaggtggatcacctgaggtcaggagttcgagaccagcctggccaacatggtgaaactccatctgtactaaaaatacaaaaaattagctgggcatggtggcgggcacctgtaatcccagctacagcaacttgggaggctgaggcaggagaatcgctcgaacctgggagacggaggttgcagtgacctaagatcgtgccattgcattcaagcctgggcaacaagggcgaaacttcgtctcaaaaacaaaaacaaacaaaaaaaaatcagaattatattttcacttaaagctcaagaagaagctattttgtcttattcaatacaaagccccaaaagaaactgaaataacgtggcttagagtattaattaaatgcttggcttagaaaaggattgtagtccatgagctggtttcaatggagtcctaaacactctaaacgtaaatgtaacatcttgtatatgggtatatgtggacttttctgaagagaaattctgtatttttattagaaaaccatgaaccaaaaaaactttaagaaacattacgtgctgttaatttgctgatgtgtctccagcatgcaactcattaactggaaaatgaaagaaaagaaataaaactttgttccaggaatttggtggagttcggatggatgtcttgctgtctatacatagcaacataatgtgcagcttatgtctgggctccacttgtgagttatgatgccaatttacagcgtggctccaatagctgttcagaaactctaacacaccacagatttatttatctgttaatatttcacatttttggtgcttttgcatttttctgatgctaaatcctttgcatcctaccagatgagatagtgatgaagcacacagaataccttctgtgtcatgatattctaaaaaagtagatttactgtttcactgctggcatgactttacacatgcaaacagttatcacaatagtaaactgtttacctactctaattacgatggaaacaaccagtaacactgccatttgtacagcacttagtgcaatgtgtctagccccaaacactataaataagagtaatttacctccatggtcgcacagagctttatcccacaaataatttgtagttaagtcttgttaaaccttcactgtaatggaaacggcatcaacataaaattgaggataatacagtattacacatgatttaggaatgaaactaacattctgtgcctgctggaccagtcctgtgtctttgcctagaacaccctctagcctcccaccatattatcaagtcaataaggaggaagaatccaaatgaagccaggtttcacttcgcatcagggatgaggacaataacaaaattcaagaattgcttcaattaccaaaagctttaaacctagggtatgtataagaaagttaatggtcaattattccttatagtatttaaaatctgtgctttaaacctgagaacagattactgagctgttttaataaaaaggaaatctaaaaacattaaattaagtgttcttaactaaaatgtctgccaagcttaaaaagttccttatgctatgcaaattacttagatataaaatatttttaatgtcttaattcagtcaacatattgtacttgcaaccctactgtaaacaaacactaacccagaatggctagggaactgcgcattttgttgaattcttcccagatactgcatactgggttatcaaataacaaagttatcaaattaaatgttactgaatgtagtaaattttatctgataattcaggaggcactttaggaagactttgaatgtgaattttaactgcactaaactaaatgtagtgttagaaattaataaatgtagtattagaaagcatctaacaacaattgatataccatggaaacctccttttggaataacttcttcacacctttctgtcaagtgactttctcaccaaatgacattaaatatcagtagtcatttgaacttcttaacttttataattctggataaaagagagtttacaataactatcaaaaatcataagtgggctgggcgcggtggctcacgcctgtaatcccagcactttgggaggctaaggtggccggatcatgaggtcaggagatcgagaccatcctggctaacatggtgaaaccccgcctctactaaaaatacaaaaaattagctgggcgtggtggcgggcgcctgtagtcccagctactcaggaggctgaggcaggagaatggcgtgaacccgggaagcggagcttgcaatgagccgagatcatgccactgcactccagcctgggcgacagagcgagactccgtctcaaaaaaaaaaaagaaaaaagaaaaaaaaattcataagtgaaaatgcttgacaaaaacttaaaagtccatacaattaatccgggtgggattagaagctatattagacctagaacttgggcctcaagtctttacccaacttgtgttttagtaacattatatttcaacaattatgaccccaaccaaatccagtccataaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaaaaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatatttgaaaaaaacaaatttcaaacaaaaataagcataaccaaatggaaataaaagaataaataaatgtcaatcatgaagtgtgagtgtacacaacggaaagtcatacccaggcttctccacccataacttagacagctacagggactggttacgagcaatagaaagatgtcaaacatgatttttaaaaataactactaccagttttgaaaagatccctggcgaaagaaaccccaaaatcaacttaataaataactgtacaccaaagggaaagggttgtgttttctttgatggtgtattctctatggcaagagagttttaatattttatcaactgctaagaagataagcataacctctttcctttaaaacatatcaccctcaagtgtcttctgtccagaatccatagaagaaatttttgtcagagaatccagcccttgtgaccagacccctgtagaagagggaatgcttcctaaattccggaagtcgctgcaaggattcagtttaaactttcatgatattctaatcttaccatctcaaaagtagttctgtatcaggggatctaaaacaatgtatatctggccaggcacagtgtctcacacctgtaatcccagcactttgggtggccaaggcgggtggatcacttgagatcaggagttcgagaccagcctggccaacaaagtaaaaccccgtctctactaaaaatacaaaaattagctggtgtggtggcgcacacctataatcccagctacttgggaggctgaggcaggagaaccacttgaacctgggaggcagagggtgcagtaagccaagatcgcgccaccgcactccagcctaggcaagagtgagaccctgtctcaaaaacaaaaaacaatgtatatctcaaaatctttctcagaacatggtgccaattatttcttttaagctgaaataatctgtaccttgggggttataagaagctgcataatcagtaaaaggatagaaaactttaaagtatttcagattttaaaccagaattcctctaagatttcaaaacatggtccatgttttatgttatatttctataaatacaatcaaagcataccattgtacagtactaatctcaactggttctagatttaagcaattagtttgaaaaaattaggaatgggaataagaaagtcctgttgaaacaatcttagattgttaagagtccgtctccaaaaaaaaaaaaatttggcccaacttgcaaataataaaggattatttaatttggaaaaatattctaggattactcagaactactcaatttaaaaacttaaaatatctatcattatttagattttagtaaggtggagagaaacataggtagcctgtaagattaaccttccctaaaagcaagctcagagaaggaaggaggagggagaagaaaaggaaattcgctgcagtactggtggcctcaacccctttatgaaaacacatgttctcatttggtgttacactattctgattcatgttgaacatttgaaaaccaaaggaaaaaggtcaactaaaaatatttaaaggaaaaaaatgtgagaatgaatcaaatgataaaatcataaagaaaacaagaaataaaagacattagataacctttgtaaaaattactaaaattaaaaagaattcattttgcactttgtgttcacaaagggaaatgaggctccatcaaaccctgcagagcacaagaggaagcaggttgtttgctcaggcatcagcagaaataggccccgaagaactaccctcagtttcttctacatcatgtccaggaatgaaaagcaaagctctgcaaaatgctgaaggttttagaagtataacgatgcttaggaaagatcactggtctggtgttgcagcagccccagtgttgagagacacgctaggcttctaggaggagaaaaatagagagggaggaagaagtaggaaggggaagaaaagggtggaaaagcacaggtcattagtaaacagcaagttcaatatcacaagatgctcataaaccaaagctattaatgaagctggtttgctctcgggactatagataacattctgaaggaaacagaaatgggaattttcaaaatggcattgagttagatgctccaggtagtgatggccaaattagaatgaagtcaccacatgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaaatggcatccactctttcaactgcctaatcaagtcaatcccctccagcctttccttaccctggttaactggttcctgcttaaagaaagctgaatttactcattttttaaaagttcatgttcaaacttctcctttaatcacagggatatttgcataaatgttttcttaaaaaccacatcacatagatgactgctttcaaagcagacacagaaagtcaatactacatttgactgagattatcaaagaaatacaaaaacatcaattcacaaaactggaagataaagtggcatttctggttgtttctagcttctaaagtaaagagttcctaatttattaagttgctaataaggatgtatatgtcacttggtaaacattcacaacaaaaagaacttggtcatcaaaaaatctgatgtataaagatatatacaactttcctatggtcatagaataaagaataaatcctagaatagctgctattgctaacagaaggctttctggaagccttagaaaaagagaaatactgtggtgcctcacagaagggcttctcatagctgaggtatgcatataagagaaatacagaaatatgacaaatctagtaactacctccactgcaataatatgaatcaaatgtatggcccagttaagagcacacttgcaggaaacaatgggattgatcattagaagtcaactcatttgggttagcagtgttggcctgatcacaactgcaaagtaaatgcaggtatttatgaaaataaaacacgcaactctcacatcagctacttaagaaaatatttatatagtatatccctgggactcctgctactgctttgagaattttgctcactacaaagacattggggcagggggttggtgctggttatgagacaggaacccacagaaactcaatgctaactgaaagaatatcaaaaccctagtaaagagctaagagtttaattagaagtaaatttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagaacactaccaccctcagaaataattcatatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaatttaaacatttaacaaaaggaaacccagaaacagaactgaacagaatcattaattcctagggcacccaagctctgtaaagtaccagttccataggagagcccctcataatagcaagtctaaatctttttcattctgtaaattatcaaagattaccattaaattcagtaaaaccatcatggagcaacacaggtttggtatcagcaattcaaatccaaatcaaacgctccaagaacacgagggcatttgttttattattattattatttttgagatggggttttgctcttgtcacccagactggagtgccatggtgcaacctcggctcactgcaacctccgccttctgggttcgagtgattctcctgcctcagcctcccgagtagttgggattgcaggcacccgcccccatgaccagctaatttttgtatttttagtagaaatgggatttcaccatgttggccaggcgggctcaaactcctgacctcaggtgattcaccgccttggcctcccaaagtgctgagattacagatgtgagccaccatgcccagcggaggccatttattaattacttattaattcccacacaggaaatccagggtaccatcattgcttctggatgaagattgcatggaggtaaccagctgtatttctggaagcagaggactcctttttttttttccctcttttttttttttttaaggaaattagttgtatcttattccctaatgactaaggatgttgagcatcttttcatgtgtttctctgccatccctttgtcttctttggtgacttgaatggtcaaattttttgactattttaaaactgaactgtttattttcttattattgagttttgaaaattctttatgtattccaaatatcactcctttatcagataaattttgtaaaaatttcttccctgtttctaacttatactgtattttcatttacttaactgtgcctttcaaatagtttttaatttttatgaagtaggtcacaggatttttttccccatgttttcttctagaagtcttatagttttcatatttacatttcatattgaggcctacggtacattttgagttaaattttgtatatggtgtaatgatgtgggtctaagtttctattcctgtacattcctaagtttctattcctgtacctaataattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctcccaaagtgttggtattacaggtgtgagtcactgcgcctggccttgttttgtttctttgcttttccatataaattttagaatcagtttttgatttatactaaaattcttgatgggatcttatatgcaattgcatataagactatatagatcaatttggggattgactatatagatcaatttggggatgtacaactttttctgaaagtctctgactatatctaacattttagcaaccagcctagctctgcagtcaccttgctgaccgaagaattcagagatattattcctaagacaataagtgaatatctacaatatatgctactaaaataaaaaatgcaagattttactttggaagaccacaaacatgctgtccaaccccttagtcctcataaatacaaggcagaaatctttcacacaagcttcttgttgaaaagatcattcattctgttacttaagaggaacagccaaagagaacaatctaaaagaacaaggcagtccaaaaccagaatataatttaaataaaagaaagaaataaggaaggaaagacaacagaattctattaaatagccgctatgtaacatataccctgctaagtcttcacaaactgcattttacttatccagagagatgccataaatatgctccatcccacatttggcataagtaaattccctttcacattcacacaataagcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatcacaactactctagaggctgaagcacaagaatagcttgaacctgggaggcagaggttgcagtgagctgagatcgtgccactgcactccagtctgggcgacagagcaagactccatctcccaaaaaaaaaaaaaagctttattcccatatatttacctatgtgattagggtttcttcactatgatagctacaaaaacaggaaaaattgccaatcctatttcatcagagaaagaaatattgatccacagacccatgatttaattgagaaaaataacagaccccatcatctcataagaaaagcatttccaataaaattcaacttgtatagtaataacatcaaaaattacaacctatgttggccgggcacagtggctcatgcctgtaatcccagcaatttgggaagccaaggtgagcagatcacttgaggccaggaattcgagaccagcctggtcaacacagtaaagcccatctctactcttcttgaggaaacaaataggattaagtgaaaatgaagggagatttaaaaaaaacataatacatgcaatagactgataaatttcctctggaccaagttaaaacacagaacctttgtcacaggaactttaaaaattaaaatttaagtttacatacatatttagtagcagaaacatattagcacaatcaagaaaaaacttttaagcataaaaatatattacattaggataaaagtctgagacatgttatggaaataaaagttcaaggactcaaaagaagaatttaaatttccaatgataaagaacagcttgttcgtatatttttaaactagatgatggaaaccaaaatgctatatatttagaagcatttggatacatttagcagaatgaggtaacttatttttatgtggcaaaagtaaaacattctcaaaattacatgttttacaactaaacttttgctacaaaattttagatgtaaacttaatgtacaaagagacagaatttatcagaattctgagtatgtgaccaaaagttaagaccactactttagaccaagttaaaaagaaagcttgatatatactgacagaaagttttctaagataataaactaaaaaaagcaagttaaaattcatacgatttgattccatttgtaaaatggaatcaaatgaaagtaaagccactaaattttttattgtatgtttgtaactgcaaagaataaagtcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcaagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagtgcagtggcacaatctcagctcactgcaacctctgcctcccaggttcaagcgattctcatgcctcagcctcctgagtagctggggctacaggcatgtgccaccatgcccggctaattttttgtatttttagtagaaacaggatttcaccgtgttggccaggctggtctctaactcctgacctcaggtgatccacctgcttcggcctcccaaagtgctgggattacaggagtgagccaccacgcccagacaattctatttgtataaagacagggtctcactaagttgctcaggctggtctcaaactcctgggctcaagtggtactcctgcctcagtctcccaagtagctgggactacaggcgtgagccaccatgatcagcctcgtccactgagctttaattcaatgctactttatttattttgttgctcaaatttttccagtgttggctattgggaactctttcagttgactcctgtgtccctctgacacactatctctgtcattgtgggctttggagcataactccaacagtctttttataaatgatctgtgcaattaaaggtaatttttttttccagtgaagggcataaataatgagatttaattgcgaataatatgcataatggaagtctcatttgcacatatctgtttactttctccctgcctttcctcctgcctcagcctcctgagtagttaagactaccaccacacccagttaattttttattttttttttctttgtagagatgcagtcttgctgtgttgctggggctggtatcaaactcctggcttcaagtactcttcccgcctctgcctcccaaagagctaggattacaagtgtgagtcaccatgcccggcctccctggtatttttgacctaaaatgtgcaaaagggaatttctgattcataaaatgtgactttcatataagatgcagcagaacacatttcaactggcttggaaaccagaaaattattcaaaagctatttgcttagatactaaaatagtaggtgaaagttggattagatacaggatacatacatagcctcaaaatatctcctcacaaattacttattcattacaaggagaaaaatataaattttacagtaaagaggctgggcgtggtggctcatgcctgtaatcctagcactttgggagggtggggagagcagatggcttgagcccaggagttcaagaccagcctgggtaacatcacaaaaccctgtctctattaaaaaaaaaaaaatacacaaattaaccaggtggccaggggtggtggctcagcactttgggagaccgaggcaggcagatcacatgaggtcaggagttcgagactagcctggccaatatggtgaaaacctgtctctaataaagatacaaaaattagccaggtgtggtggcacgcacctgtaatcccagctactcaggaggctgaggcaggagaatcacttgaacccagaaggcggaggttgcagtgagccgagatcatgccactgccctccagactgggagacaaagtgagaccccgtcttaaaaaaaattaaaaaataaaaataaaaattaggctggggggtggctcatgcctgtaatcccagcactttgggaggcagaggtgggtgaatcacctgaggtcaggagtttgagaccagcctggccaacgtggtgaaaccccatctctaccaaaaatacaaaaattagccaggcatggtggtgcatgcctgtaatcccagctactcgggaggctgaggcaggaggatcacctgaacctgggaggcggaggttgcagtgagccaagatggtgccactgcactccagtctgggcaacagagcaagactttgtcaaaaaaaaaaattaaccaggcatggtggtgcatgcctgcagtcccagctacttgggaggctgaggctggaagactgcttgagcctggggaggtcaaggctgcagggagccaagattgtgccactgcactccagctagggtgacagagtaaggccctgtctctaaataaataaatgcttttttttaattggaaaaaaattacagtaaagaaaacaggcagacactaacaagtgatgaaagttattatcaccaataatgtgatttagtgacatcatgtgcttcctgatgtggtgcacttaggacacatcatatttacatagtactactgccaaaaatgtggaacttgaatctaattatgaggaaatgccaggcaaacccaaattaggggacttctaaaaaataacttgcccatactattcaaaatattaaggtcatgaaagacaaagaagagttgaggaactgttccaattaaagaagactgaagagacatgaaaactaacgtgattccagatttaattgcagacaagaagaaaaaaatgagaaaggaatgtgttgaatctgttgggacaactgatgacaatgaaataaggttcgtggattagacaggaatatctcatcagcatttaacttctgatctctatcatcgtattcttgtaatgtgctaatgcctagttcttcggggaaagaggtgtgagttctgcagtttgttctcaaataatccaaggggaaggaactatatgtaaatataacaagaatgataaagcaaatgtgcaaaacagtaatgataaatccaagtaaagggtacatggtaggttcttggctctgttcttgcagtgtgaagtttaacaaagtcatttgcttgcagaatattatttaagaggtggggtctttggggtcttgctatgttacccaggctggactcaaactcctaggcttaagcaatcctccttcctattaagtagctcgggcagggctacaggtacataccaccatcctggcttgcttgcagaatatttttagcaatgaagtggtttttttgttgctttgttttttgttttttggggggtttttttgtattttttttgagatggagtcactctgtcgcccaggctggagtgcagtggcacaatctcagctcactgcaacctccacctcctgggttcaagcaattctcgtttctcagcctcctgagcagccgggattacaggcgcatgccaccacacctggctaatttttgtatttttagtagaggcggggttttgccatgttggccaggctggtctcaaactcctgacctcaggtgatccatctgcctcggcctcccaagtgctgagattacaggcttgagcccccgggtcccggtcccctgctcttctttcagactagggtactattattatgaactatacattttggtacgatattttttttccccaaaaagaactattagttatgagataaaagtctgttttcaaatcaaagtcagaaaataactatttttgcaaaaatgtcacactaattttttatgcatatatataaacttccctaaatatgatcatgagactattaagagggtttaggattagaccaagtacacctaccctaaataaatatctaccattttggagacacaattgtttgttagtctgtacattaacacaacccaaacctgaataaactgacaaacaaaaaccatttcaattcagtgtaataagcaatgattacacatctatcatgtgccaagagcagtggtctctaatgcagatctggccaggtttctcagtacccctgcgccctcagtttctcacaaaccatgagattcttcataatttcacttgatctgcttctccatgattctctccggtcacttgtcactgtaacctttgatttcttaaccctgagaaacttgaggtcgctagtaaactttgattatgctgtgccatcctgctttcgctaaatgtgtcattctccatgaaatatggcagtaaacaaaatattattcctgtgctagagcatgttaataagtgtaagataacaaatagcttaattatgatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactaaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggctcacgcctgtaatcccagcactttgggaggctacggtgggcggatcacgaggtcaggagattgagaccatcctggctaacacggtgaaaccccgtctctactaaaaatacaaaaaattagccgggcgtggcggcacacgcctgtagtcccagctactcaggaggctgaggcaggagaatggcgtgaacccgggaggcggagcttgcagtgagccaagatcgcgccactgcactccagcctgggtgacatagcaagactccgtctcaaaaaaaaaaaaaaagaaagcaaagcaaaaagatagatgagatggatgtgagattcagacaggattttttttttaatgataaaaaaattatagtatgtttgatgctggtgaatgacccaattgaaagaaaagaactgatgatgcaggagacagaagaggtaactgtgacagcagtggcctgagtgacagcatgaacagttcacccataacagaaaaagagcagacaataagggcatagatgaacataggtgaggaggaaatatgtggtgggaccatgtggaagttctgttctgattaagccaattaatttatgaatatgacttatgaatatgaacaggagagcaagtgccagaagtttcagagagtagatgtgaaacagttgtctaggaaagtgaaatattttacaaactcatgtgaattagtggcagagtccctcagtttgtgctctgtattgaaatgaagcaagattcttttacatttcctgaacatacatctaataattctatttgaatttaaaaaatggatttttagtttttaaaaactatcagtgagatactagatcaagtagaaagtatgtgttcatgaaaaaggtatagtttcacagaaagaacaggggtttattttatttatttattttttgagacggagtctcgctgtcgcccaggcttgaatgcagtggcacgatcttggctcactgcaacctccaccttctgggttcaagactctcttgccccagccccctgagtagctgggattactggtgagcaccaccacgcctggctaattttttgtatttttagtagagatgagatttcaccatgttgatcaggctggtctcgaactcctgacttcgtgatctgcctgcttcagcctctcaaagtgctggggattacaggcatgagccaccatgcccagccagaacaggggtttaaaatgagaagatccagtagctcatgtctgtaatcccagcactttgggaggcctaggcggaagggctgcttgaggccaggagtttgagaccaacctgggcaatatagcaagaccacatctctatttaaaaaatattgttttaattgtttaataaaaataaaagtgagattagaagatctgggttcaggttgtgctgtcattattaactaaatgatcaaatgcaaccttctcatttctaatacttaagcttcacctgggaagtgggactaaatgcagtaatacaggatgtcaactgtacagtgctaaatagtaattgttattctcactgttattagctattgttattctcactgttattaactatatgttgaccaactgtaaatttatctatcaaccacctatagaataactgtaggctgatcaagaaactttactagaataaaataaaatgaaagcaagaagaggttagaaaggaagaagagaagctggattctactatacatacaacacctcacaatctaaaaatataagcccaggagagaataaaaacaacgtaacaacactaaaaacaataaggttgacaagtagaaaaaaggcttgtatatttccctgccagataagacatactggaccctaatcatactgcacattactggaaaagtcctaattcaaaagatgctataatgtgttttctcactgactgacttccccagagaacccccatttcatgaaatgaaaactttctcagtgaaatacacacagcatcgaaaatagcacactttttttttttagaaactaatcacattctctgagatataaagatattcaaatttactttattttgttgattccctctccccaggagatgtcagattcccacagcaggcaaatcagcttggcagagaagtagcaagaacctgagaaggcatgtgtgctgtgagtcagccttgggcaaaacagccaggtctcaatgcaagggaaccctctggtgctgtcagacccatgccaacactgccctctactggccaattaagctggttgcaattttctgcaaaagaaataccagtgtattaaggagaaattctgcagtatctattaatagttgtcacttaggcccttttccatggattagtgtttctcaatcatgcatgtgtatccgagtcacctattatggcttgttaaaacagactgctggtgtgtggcagggtacggtgtctcccacctgtaatcccagcactatgggaagtcaaggcaggaggatcacttgagcccagcagttcaaaaccagtccagtccaggcaacacagtgagaccttgtctttactaaaaatgcaaaaaacttagccaggccattgccctgtgttaacttcttattctatgggaataagcttttagcttcaaaggccttatggaatgttgaggagaaagcattttctcgacttcagaagaagaactatttaatcacacagagaacagaaaaattaagtgacttgttccataaatgtgctatttgtgtctgagggtcaatactgtgctagatgatcatctgaaagaacaagagtcacagatgtttgcttcgtcattcacatctaagagaaagggttctatcttttgtctccctcacctagaaaatagggccatataatgctgataatgaacaattaaggaaaacaccattttttaaggaaaaaagtcaggaagtacataattttctttttatttttttcttattacagccgtggtgcaaaacaagtagtacacatatcctgaaaaagtatttgagaattgtttcccaaggtgataggcattttagaagaagagtttgacaccaattttatttctaggtattggtatttagatggtttacacaggcaatgctaagataaaatacttgtagaagcaagaataagttgaagtgcaaaaggaaatgagtatagtagatccaaagaaaaggaataaaggtcggggggttcttgtgttgccaggcatgaaggcagaaatcatacttagagaaaaaagcaattttcctactttgtcataaatgccataaaagcaaccctgctttcttacttctcattttataagttgaagacaattagggtggacatgtaagaattaaaggaaataaaacaccattgttcaaagagttctattatgtgtaacctactcaaccgtcccttctatatctagaggcaagaaaatggttgataaacttccactggttggcctaactaagcctgttgtaagaacatatcgagagcactaggctgggtgtggtggctcacacctgtaatcccagtgctttgggaggctaaggcaggaggatcgcttgaggccatgagttccagaccagccagaggaacacagtctgactgtcgctataaaaataaaaggataagcaaggcacgcgcacctgtagtccaagctattcaggagcctgaggcaggaggaacgtttgagcccaggagttacgttagatgttgcagtaagctatgattgtgccactgcactccagcctaggtgacatggaaagaatctgtcttttcttttttttttttgagacggaatttcgctcttgttgcccaggctggagtgcaacaatggcacgatctcggctcacggcaacctctgcctcccgggttcaagtgattactcttgcctcagcctcctgagtagctgggattacaggtgcccaccaccacgcccagctaatttttttgtgtttttagtagagacagggtttcaccatgttagccaggctggtctcgaactcctgacctcaggtgatccacccgcctcagcctcccaaagtgctgggattataggcgtgaaccaccgcgcccagtaagaccctgtcttcaaaaaaaaaaaaagtgtcagcaatcagcagtagtttactgaacctcatctaagaacaaaatcaaacttaaagttagatgtataataaaacattaatgaagtctagggcccttccatcacttctaaagatgtattcagaagaacatcttgtttagaatgttctccaggaaaaacacaaatatgaaacctgtcattatggcaaaaaccatcagtccgataatgtataaaaatcagacccacagcagagaagtctccattcataaagaactcactaattgcaccagatttctacaagactaaataaggcggcttccttcgtttttcttatttgatgtctccaaacagccatcaccccttcctttaagttaagacttctacaacttttaggaagctggtatggaaaaaatgtagtaatttacaacctatcataattataaactttattattattattatttttagagacggggtctctctctgtcacccaggctgcagcacagtggtgcttttatggctcactgcagcctcgacctctggggctcaagtgattgcctcctacctcagcttcctgtgtagctcggactacaggcgcacactaccacgcccagctataattataaactttaaacatggtatcttcaacaagttcgtggaaaatgcattctatgaaaaaattattcatggatttcaagggagtttttttgtatcaaaataactcatactccagcctgaccaatatggcgaaaccccatctctactaaaaatacaaaaattagctgggcatggtagcatgtgcctataagcccagctactcaggaggctgaggcaggagaatctcttgaacacaggaggtagaggttgcagtgagccgagactgtgccaccgcactccagcctgggtgacagagagacactccatcttaaaaaaaaaaaaaaaaagctcatactaacttgttataacacgtctgaacaggatctagtttgaagcactaaaaaggataaaacatcagtttgaaaagagcccctaataaagcaacatgaattctgctaaaattgaagcaaaagcaaatggtaaatttatggtgaagcttggatgaaagaatggtgaaatcactgatgctttgtgtaaagtttatggggacaatgccccaaacaaatcagtagtttacacatgaataacttgttttaagacatcagccagatgcagtggtccgcacctatagtcccagctacttggaaggctgagacaggaggatcacttgagcccaggagttcaaggctgtagtgtgctatggttacacctgtaaatagtcactatactctaatttgggcaatgtagtaagactctgtctcaaaaaaagaaaaaaaataaaggaggagatgatgttgaagatgaagcccaccgtggcagaccaccaatatcaatttgagaggaaaaaagaatgatctaattgaagaggattgacaattagcagaaacaatagccaataccacagacatctcaattggttcagtttatacaattttggctgataaattaaaattgagcaaactttccactcaactggtgccaaaatggttgcatccagatgagctgcaaagagcagagctttcgatgtaaattttaaacaagtgggatcaagatcctgaagcatttctttgaagaattgtaacaggagatgaaatatggttttaccagtataatcctaaagacaaagcacaatcaaagcaatggctaccaagaggcgtaagtgctgtagtcaaagcaaaagtggatcagtcaagagcaaacacaagagttttttaggatgctcaaagcactttgtctgttgactttctggagagccaaagaatgacaacatcttattatgagggtgttttgagaaagtcagccaatgctttagcagaaaaacagccaggaaagcttcatcagagagtccttctccaccaggacaatgctcctgttcattcctttcatcaacaaagataatttgtgacagttttgatgagaaatcattaggcaaccaccttacaacagtcctgatttggttccttcttttttgtttcctaatctttaaaaaaatctttggtagcaacaaaaaattaaaaacttaaaccaaaaaaaactttaaagggcatccatttttcttcatttcttcatttttcttcatttaataatgtaaaaaagccaggcacagtggctcacacctataatcccagcacaaaagaaaaacaaatatttactccaaaaaatttggattccttaatggaaaacgggaaaatctattctctcttaatccataatgcacggtggagacatttgttctttgactgactaacataaacaaagaaaacctagtatgaagaaaggaatgataagatgtaaatatggtagcaactagtcatggttgagatgctcttcccatcctaatattaacttaccctcatcagtcataggtgaaagaagctagctgcttttcgttttctaatttcctttaactgtgcattgtttccatcatctgggaatgagcctaggtggataaggacagtgaggtggtagcagtagattttcttgtgcttcatcttgagttatttgatccatgtaacattaacttggcccaagaggaggaaagtttttaagacattattttatttataaaaaattaaatcctccctgctacttttgatatgtaaatggtggctcatgcctgtaatcccagcactttgggaggccaaggcaagtggatcacctgaggtcaggagtttgagaccagcctggccaacagggcgaaaccccatctctactaaaaatacaaaaattagccaggcatggtggtgcaggcctgtaatcccagctactggggtgttgaggcaggaggatcgcttgaacctgggaggcggaggatgcagtgagcagagatcgtgccactgcactccagcctgtgcaatagagcgggactccatctcaaaaaaaaaaaaaaaaagttcattaactcagaaagactactccagaaattggcgagtggttactccaggaaggagaactgtctggctagggtgtagggattgggagaatttgttttaccgtacatccctttggaccaattggattttgtacatgtgtattttttagcctgttcaaaaaatgtatgagtttctggaaaattgaattaaaggataaaaataaaatatgaactttacttctcaacataagcttttgcaacatcaagatacttttgtaagcaatgatagcaactttttttcttttcttttttttttttttttttgagacagagtctcgttctctcgcccaggctggagtgcagtggcacgctctccactcactgccacctccgcctcccaggttcaagtgattcttgtacctcagcctcctgagtacctgggattacaggtgcacaccattacccctggctaatttttgtatttttagtagaggtatggtttcaccatgttggccaggctggtctcaaactcctgacctcaggtgagccacctgccttggtctcccaaagtgctgggattacaggcgtgagccactgcacctggtctggagtaaatatttatatggatataattagaactctcggtacttttttaaatgagttgtggtctgccccccctccccaacacacaaattaaacatatattaaggaagcaggttttcttcttccacttggctgtagaaagccaaaagcaacgtcactcccaccctaacaacaagaaacagccatatcaactacaaaaaacttgaattaattggaaagccacctagtagtatgaaatccaaagaaaaacaagcccctccaggaaatatgggaggtgaacaccagctctcctgtatcagagcatgtgcagaagagacattgggtaccctacaagcaggtaagaaaaattcaagtaaaaattgtagtgatttgtcaaaggtaaatgaaggctagcatgagactatggggcccctcaaatccacagacacaaagggaattcacactcatttgcaggattgtcttcacagatgtctgccgcatgctcacaggaaagattggaagcagggtgagggaccagacagagcctccctccatggtacagacctggagaaggccaccaccattaagggaaaagcatgaacccctcccactgggatctttctctcctggggaaggagtacaaaccctgtcaaccccagagcacacaagaagaccggctgtagctagggaaagagtaatagaaacatactttataaacctgagagaggagcaagaaaaactcctcatccaggatcctacaccaataccatgagaagacgctactactgtgaaaaggataataacgttgagaaagacccaaaccgtgagattaagcacaggattaagcacaaaatgggacaataaaaaaacaaactctgcctgccacctggctagaactcttccgataagagagaaaagagcatggacaaggacccctctgaggcacgggtacacagggaaggctgaaagagtggagcaagcacattaaagaaataccttccagggcctcagtccccactctaagcatagaattaaagggattgaagacagtagtacactgaaggcaattacggtaatgacaaaacccaaaactagctcagctcctgttaaaatgactaaacccaagagacatgcctatttccaaccataacaccttttggcctcagcctactattttacatgtgagatccagcattcaatcaaaaactaagacacacacacacacacacacacacacacacacacagagcaatcagactgagagatgacccagattttcaaattatcacacagagatttaaaacaactatgattaatatgttaaagtctacagtagaaaaggtggaaaacataggtgaacagatgggaaattttgacagaaataaggaagcttataagagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttcccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatcaaaacctgatttaagctgtcaccttaagaaaccagaaaaagaataaatcaacttaagtaaacagaagaaaggaaaaaacaaagatatgagaagaaattaaaaacagaaagacaatagaaaaaaattaatgaaaccaaaagctggatctttcaatacaattgataaacctctacctagacttatcaaagaaagaaagaaagaaagaaagaaagaaacatcacaaattactagtataagaaatgaaaaaggggacataatagatcctacagacattaaaagcatatctccattaatctgcaacatttatgccaggaaagggaccaaggaattccttgaaagatacaaactaccaaagctaacttaagaaacagataactggaatagttctatgatctctgaaagaaactaaattcctagtttaaaaatccgacagaaaattccaggcccagatagctttattgatgaattctatcaaacactgaaaagaagaaaaaatatcaattctatgcaaactattctagaaaagagaaagaagggaacacttcccaattcattttatgaagtcggcgtgacctcaattctaaaactggacagaagacattatgagaaaactacagaccaattccctcatgaacacagatacaaaaatactcagccaattattagcacatctgatccaggaaaatggcaaatttctcttaaaggctttaattatgctttaatcctgaggtgggatgactccaaagacaacaaatggcatctgattccagtctaaatgaagttctgatataaccgcagaattttatttaacttttcaaagctactttcagagaaaaggcacagtagacagtttaatttaggaaattaagaagaagattatatggttgttgaaacattagagaagaaacattagggttaaaagtcatccacagactcatgaacgctcactcaaagggtggtaagtctacctcctcggtatctaacaaagaaacataaagttactagcctacactaaaaaaactcagctcaattctcagtttccaagattataccaaaggcataatccctaacctgctttctgaacatatataagcagtctggtttaaatacttaccttcaatctggctagtttctgagcacggtttcttctttgactctgagttcccggttttctcatcaacatccaggagaggaatatagtctgtttttccaacagtttctcccacaacatcatcaaaggcctctgcctctagtgtggcaatgaagtcccgctttatctctccctcaatgtctggagatggttctgttaatgcatctgcaagactgaggtcagccattctgcaccactgcaactgcctggtgaagaggaaaaagatctttcatgtaacgagcactgcaaaaggaaaaacatttctagaaactcttgtcaattgtttgaaacaaacaaaagaatcaaaatctaagattttacagctagaagaggctccctcatttgaaagatgagaaaaataaagctaagaaatggacagtctgacccaaggtaactcaccgctagttactcttttctcacatttctgggggtggagggaggtggtggtggcaggacaaagcaattgcaattgtgtcctttctatttataagaaaagtgaggtgtaaaaaaaccccacaatcaacatatccaaagctatagccagtaagattcaaatcaggtctttacatagttacattactatcggacaaatgaaatcaactttcttgaccaaagactgtgagtatggatcttatcttggagtgagtacctgcttcttcatgaatcacttgtggatagtcctgtcaaccaaactacttagccctgccagcataaaaaaaaaaagacacgtttccctcaattagctaagggagatggtccctctctgtagtcacgtatattaccatttttacagactaccagcttcttaattacataatctgcagttaagtaaatctactggcagccataaaaaagaacgagatcatgtcctttgtgggaacatagatgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtgaaccgaggttgcgccactgcactccagcatgggcgacagaggaagtctccgactcccccatcaaaaaaaaaaaaaaaaaaaaaaaaaagagccaaaggcctgcaataaattgggcaccattcaaatgcagggcataataggaaataaagtgtgcaaggtactacgcctgctttcaaaaagtctaacagaaactccaagagactccataggataagttgacatataagctatgttgttgacaaggtaaatacaagtcaaacagatccttagttgcacaatgtaatggccactacttgtgtttgtccagaaatctattcttcctatctcccctaatacaaaccaatccctacccctatagggtttgggacatgactagagttgggtcaatcagaagtcaagaagaagacagttggaaaggatcatttattgactacacgctggaagaaaagtccatgagtgacagctatttagttgccctggttgactacttcaagtctaagtgagcggccttcatctttcttttgcctaatttagccaatctatttctgttgtttacaatggaagaatctcaactaatacacagtctttctccaacccaaacttgaaaaagtaaaaatatactatgattcaagccacttaattttcaggctttcctttcaagctgttatccaccgtctacctctctccaacaaatgtacttaggaaaaagaaatagaattaaagcaaggaatatggtcctatcttccttccttcttattttatcttcatctttgttcccacacactcctctcctcccacttacatgctgtgaggctaccatgattacaaaacatgtacaaagcaaatacttccagaccctgaaaaatcagaagtcatcgtacccccaattcccaaatccaacaagcaaagggtgttgctatatattagagtggtggcacagaggcttaagaatcaagatccgatacccaaataagtacagacaggataattaaggccaggggcaagatctacatcttctaggcaagtgtctagaaaaaaaagatagtatgtgttcagtactgggaatgctggagatagtttgtctctacctatatggagcttagtgaaaacattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtcttgcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttcttaaagcaaatgtgatatttaaatttcctgtgactatactaatgagttcctaaatcatatctttttattttttatttttttcagacagagtttcactcttgttgcccaggctggagtgcaacggcaccatctcagctcaccggaacctccacctcccaggttcatgcgactctgtcatcatactacttggaatttgatgaagttcatttaggtctcaaaaaatgtcaaaagatacgtgtgacccagatgtggtggcatgcacctgtagttctagcctttcaggaggctggggcagggagattgtaactaggagttccaagctatagtgtgcaatgatcacgtctgtgaatagccaccacaactccaggtgtggagccacgattgcatcactgcactctagcctgggtgacagagcaagactctagtctcaaaaagaaaaaaaaaagaaaaaaaaaatcacactctgagccaggcgtggtggttcacacctgtaatcccagcactttcagaggctgaagtgggaggattacttgagactaggaattcaagaccagctaggcaacatactgagaccctgcctctacaaaaactaaaaaaaaattagctgggtacggtggcatacacttatagtcctagctactcaggaagctgaagtgtcacaatcgcttgaacccgggagtttaagactgcagtgagccatgattgtgatggcaccactgtactccagcctgggtgacagagtgagaccctgtctcaaaaaatttttaaaaataaaaataaaaaataaatagggtacagaggctcatgcctgtaaccccaacaatttgagagcctgaggcagctggatcacttgaggccaggagttcgagaccagcctggccaacacggtgaaaccccatttctactaaaaacacaaaaattagctgggcgtggtatcacatacttgtggtcccagttaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaatttaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagttttgggacttggactggctttcctcgctcctcagcttgcagacagccttttgtgggaccctgtgattgtgtaagtcaatacttactaaattcctctttttataaacatacatatatatcctattagttctgttcctctaagaaaactctgaccccagactaacacagactctggtaccaggagtggttccagaggaacagaatgttaaggatggagttcttttgttggtttgggggtttctggagttggctgcttaatatgattgatccaaaaatgctgaggactctacttctaatagcatggagaacattcatagtccttggcgtgaactatttagagagttatgcaaaataaatgcatttgacactcctgattcactgctcatgaaaggtaaggactttagtgactctatacataatacctttgaccatatgtggaaaaccaacgaacataatgaagctggttggttgctcctaagttcagtgaacaaagtgatgaaagaaaatgatgaactcagggattctgtttcctggcttcagaagcagatactgagtctcaaatctgctaagattgccctgagtgagagtcttagctcctgttgagaaagagctgaaattgtggaaaaacagacataagctcttatcatgcgagtggctgacctgcaacaaaagatgcatgcacagccacctgaggtgtctactgctaaagtgagggcattgattggaaaagaatgagacccagaaacttggaatggggatgtgtgggaggaccctgatgaagctgggaacactgagtttataaactctggtgaactttttttgccagaaggaacagcttccccatcccccatagtggcagcataaccccccatccccgccatcaacctttccatctttgtctacggacataaaccctgagctgcctgaggcaagagtcatggcctcctctcaggcagttgccaggcaagataatgttgattctccttagaaggtacctgcaacacccatttgcttctagacctataactcaagtcccacaggtccctagaggtgaggttgagagtgtgacccaggaggaggtgcgctacactcaaaaagaactgttctcggccaggcacggtggctcacgcctgtaatcccaatactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctggcaacagaacgagactccctctaagaaaaaaaaaagaactgttctctaatttatataaacagcaatctggagaacaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctactcatcccagctgggagggtccagaagatatacccttgaccaatgccttgtgaaatagatttgtgagggcagcacttgaatctttgaagagccctgtaattgctcttctctgcatgtcagacctaatggtgagaaccgcagtcactcaattacaaaattgaaatacgaggggaataactggatcccaaggtggcaggggccaagtagcagcactcaaccatcaaaggcaaggtgggcgtagctaccgtaatggacagcagaggcaaagtgacaatcagaatagtctgactcatgtagagctctggcattggctaattaatcacggtattcctagaagtgaaacggacaggaagcctactgcattcccacttaatttatacaaacacaaaacttctaggtcgaatggacaaaagactaatttgaattataaaaagagaatcatggcccctcactcaatccatttccagacttcagccagtttacagacccagaaccccttgaatgaaggggaggccaggtacccttgagaaaggaccccactactttactgacaatttatgcagtgaatctttctcccatccttccccaaggagacctccatccaacctttcactttggggactactggacactggctctgggctgatgatgactccaggggacttaaaacatcactgtggtcttccagttaaactaggggctcatggaagtcaggtaattaatgaagttttagcttaggtctgacttacagtgggcccagtgggtccctggactcatcctgtggtcattaccccagtgccagaatgcataattggcatagacatacttagcagctggcaaaacccccacactggctccctgactgctaggttgagggctatcatggtgggaaaggccaaatagaagcccttagagttgcctctacctaaaaaaatagtaaatcaaaaacaatatcacatccctggaaggtatgcagagatcagtgccaccatcaaggacttgaaagatgcagaagtggtgattcccaccacatccccattaactctctcatttggcctgtgcagaagacagatggatcctggagaatgatagtggattatcataagcttaaccaagtggtgactccaattgctgctgctgttaccagatgtggtttcattgcttgagcaaattaacacatctcctggtacctgctatgcagccactgactctgcaaatgcctttttctctattcctgtccataaggcccatcagaagcaatctgccttcagctggcaaggccagcaatatacctttactgtcctacctcaggggtatatcaactctccggctttgtgtcataatcttatttggagagatcttgatcgcttttcgcttccgcaagatatcacactggtccattacattgatgacattatgctgactggatccagtgatcaagaaatagcaaacacactggacttattggtgtgacatttgcatgccagaggatgagaaataaatccgactaaaattcagggaccttctgtctcagtaaaatttctagggatctagtgttgtgggacctgttgagatattccctttaagttaaaggataagttgttgtgtttggtctctcccacaaccaagaaagaggcacaatgcctagtgggcatatttggattttggaagcaacacgttcctcatttgggtgtattactccggcccatttactgagtgacctgaaaggctgccagttttgagtggggtccagaacaggagaaggctctgcaacaggtccaggctgctgtgcaagctgctctgccacctgggccatatgacccagcagatccaatggtgcttaatgtgtcagtggcagatggggatgttgtttggagtctttggcaggctcccataggtgaatcgcaatggagacttctaggattttggagcaaggccctgccatcttctacagataactactctcctttttttttttttttgagacgcagtgtcactctgttgccaaactggagtgcagtggtgcgatctcggctcaatgcaacctccacctcccaggttcaagcgattctcctgcctcagcctcccaagtagctgggaatacaggtgcgtgccaccacatccagctaatttttgtatttttagtaaagatggggtttcaccatgttggccaggatggtctcgatctcttgaccttgtgatccgcccacctcagcctcccaaagtgctgattacagctaactactctccttttgagagtcagctcttggcctgttactgggctttagtggaaattgaatgtttgactatgggtcatcaagtcaccatgcgacctgaactgccctgcctatcatgagctgggtgctttcagacccatctagccatacagtggattgtgcacagcagcattccatcatcaaatggaagtggtatatacgtgatcgggctcaagcacgtcctgaaggcacaagtaaattacatgaggaagtggctcaaatgcccatggcctccactcctgccaccctgccttctctctcccagcctgcactgatggcctcatggggagttccctatgatcagctgacagaggaaaagaagattagggcctgcttcacagacggttctgcatcatatgcagacaacacccgaaagtggagagctgcagcactacaacccctttctaggacatccctgaaggacaacaatgaagggaaatcttcccagtgggcagaacttcgagcagtgcacctggttgtgcactttgaatggaaggagaaatggccagatgtgtgattatatactcattcatgggctgtagccaatggtttggctggtcagggacttggaaggagcatgattggaaacttggtgacaaatttggggaagaggtatgtggatggacctctctgagtggtcaaagacaagatatttgtatcccatgtgagtgctcaccaacaagtgacctcagcggaggaggggtttaataatctagtggataggatgacccattttgtggacaccactcagcctctttcccctgccatcgcccatggccaacaaagtggccatggtggcagggatggaagtaatgcttgggctcagcaacatggacttccactcaccaaggctgacctggctacggccactgctgagtgcctaatttgccagcagcagagaccgacaccaagccctcagtatgtcaccattccttgggtgatcagccagctacctggtggcggattgattatattggacctcttccatcatggaaagggcagaggattgtcctcactcaaatagacacttactctggatatgggttcgcctatcctgtatgcaatgcttctaccaagactaccatttgtggaatgtttttttggtttgttgttgttgttgttgttgttgttttgagaaggggtctcactctgttgcccaggctggagtgcagtggcacaatcttggctcattgcaacatccgcctcccgggttcaagtgattctcctgcctccgcctcccaagtagctaggattacaggcacccgccaccacacccagctaatttttgtattttcagtagagacagggtttcaccatgttggccaggctggtcttgaactcctgacttcaagtgatctgcctgcctcggcctcccaaagtgctgggattacaggcgtgagccaccgcacccagctgactcatggaatgccttatccaccatcatggtatgccacgcagcattgcctctgaccaaggcactcactttacagctaaagaagtgcggcagtaggctcatgctcatggaattcactggtcttaccatgctctccatcatcctaaagcagctggattgacagaacagtggaatggcctattgaagtcacaattacaacgccaactaggtgacaatactttgcagaactgtgggaaagtcctccagaaggccgtgtatcctctgaatcagcgtccaatataaggtactgtttctcccatagccaggattcacaggtccaggaatcgaggggtggaactggaagtggcaccactcaccatcacccctagtgatccactagcaaaatttttgcttcctctcctgcaacattatgttctgctggcctagaggtcttaattccagagggaagaatgctgccaccaggagacacaacaatgattccattaaactggaagttaagattgtcacctggacactttgggctcctcctccctttaagtcaacaggctcagagggggagttacagtgttggctaaggtgactgacccagactatcaagatgaaatcagtctacaacttcacaacggaagtaaggaagagtatgcatggaatacatgagacccattagggcatctcttcgtattaccatgccctgtgattactgtcaatgcaaaaccacaacagccaaatccaggcaggactacaaatgatccggaccattcaggaatgaaggtttggatcactccaccaggaaaaaaacccatgacctgctgaggtatttggggaaggcaaagttaatacagaatgggtagaagaaggtagtcatcaataccagctatgaccacgtgaccagctgcagaaatgaggactgtaactgccatgagtatttcctccttcatttgttaaaaacatgtttgtgtatgtatacacatgtactaatatcttcactttatatttccttttcctttatcatgtgacataagatttattgatttcataacagcatttaagtattattaactttatgtaatagtatttgggttggggattggtgtgtttctggttgtatgaaggatagttttattacattaggtgtaattatgaccttattattgtctttattttaagattacatacgatctcagatgtatatgggttcaagttgacaaggagtggacttgtaatgttaatactgtcaacttgattggactgaaggatgcaatattgatcctgggtgtatctgtgagggtgttgccaaaggagattaacatttgagtcagtgggctggggaaggcagacccacccttaactgggtgggcaccatctaatcagccaccagcgaatatagagcaggaagaaaaacatgaagagatgggcctagcctcccagcctatatctttctcccgtgctggatgcttcctgccctcgaacatcggactccaagttcttcattttggggactcggattggctctccttgcttctcagcttgcagacagcctactgtgggaccttgtgatcacgtaaatcaatacttaataaactctcctttggagatatatcctattagttctgtccctctaagagaatcctgactaaaacaagtagtgtggggctcgtgacaaaaactgatagctttgctgccaaaggggctcctgtggcatgacagagctgttgtccacagcaaatgccatctcacactactggaattataaattccactatttgaataaccactgccgaattcaggatttagcagcttttctgaaggaaccataaataggaattcaatggttcctatagtaggaactggacttggtaatcccagcctgtaatctcccagcactttgggaggccaaggcgggtggatcacttgaagccaggagattgagaccagcctggccaacacagtaaaaccctatctctactaaaaatacaaaaacagaataactagctgggcactgatttttattatttagatggtatgcacctgtaatcccagctactcaggaggctgaggcaggaaaattgcttgaacccaggaggtggaggctgcagtgagccaagatcacgccactgcactccagcctacgtaacagagcaagactccgtctcaaaaaaaaaaaaaaaagttcctatagtagtagtggcacacctgtgacccatttacaacagacgaatgtgggtgggaagccctattctatgctcgtccagcctactttacatataaagtattattgtaactccagatcatgacagggaaaatgctgagaaatgagttcattaaagagcttttaaaagcctaacagattataatgtcaaagggttccatgaaaagcaactattcagttgcttttactattcggttatgccatttccctattctatctctgacaactattattagtagttatcctttgggagctgttatgaaccaaaaactaaaaaggacgtctgtaactagttttgatagaggcaagaggcaaacaaatgtctaggcagacaggggcgggtcctcagtgaaacccgaactttaatccggaaactgtcctgggtaaatcctgagatcggattaagaacctgccttcccgtttggcatgattgatccccatccttcacctatttaacctgtacctaccctttcctaattggttttctacactgtcctgcccaccttggagtggtgtcttcgctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatctgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttgttttttttttcccagaaatccccagttttcaataaattaaagcgattatccaattttatagttattttattctgaaacatgtataagtacaatacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccatacagataataaagttaactttaaatagatttgtgagtaagagtcaagagaatttgaaagctgggtacagaagtctgtatgctttactgaagcaccagtttaatctgacactcactgtggccttgaatgagtcacctttcagggctgagttctctaatctgtaaaatgagagtgttatgttaaatgtttactgaggttgattattctatcagctacttgtaattcagctgcatcatttcagttagctataaataaaccccctaagaccctcagtgtgaatatgaacaactatcatttcatattatttcatatatcaagtattctcatttataattgggttgaggtttattaaaaaaaaaaaaaaaagctttttggcaaagggagggactgaaaacaaattcaccactgcatggtgccctgcttgagccaatctgactggagcttaagaaactccacccagttctggctaacatcaaaggagactcaacaccactctgccagaaaataagccctgtattatctaaccaggcactaagggaacacacagttttcaagcacagcactttgtatatctgatctttcattctgatgacatgcctgaagtgaaactattagtgagccgggttttttaaaataggtaaactaaggcaagaggcaactacatggcatgatgataaaatactctcttgactacaatctcactattaagagctaggtgctcataaacaggaaataaggatatatgatgaggccacagtactttgttgtatgctttactttggatagttcacaaactctggaattaattactgtactaaaaatattttacaggtctatacagattaaacagtgttaatatctaacttaattacacagaagttctgaagaaccttttaagctccatgaagtcctcctgaaaattttaggtcattcgcatctagagccactcactcggggtctgtgctcattctgtctgatgagaaattggcaatctggtttaccaatggcctgttgctgtctctgtcctcttctattcaccccttgaaaggtgctactatgggagctaaaatgcagggaaaaaactcatgaaaagctagaacagagcttgggcaaaatggcaaaaccccatctctacaaaaacatgtaaaaattagccaggcatggtggcacatgcctgtagtccctgctactcaggaggctgaggtgggaggactgattgagcccaggaggttgaggctgcagtgagccactattgcaccactgcactccggcgtgggcaacagagtgaaaccctgactcaaaaaaaaaaagcaagaacagaagcctgattcccaccatcatactcacttttcctaaccactgtgttaggaaaccttcattttactgtgtcacattagccaaatttctaccgacattcatttgcagtagccagcattctctttttaaaagtatagaatcctatttcttaatttaaaagtgggtaagaaaatgtacatccctggaaagaccattgttcatcccagagatggttctattgaagatgtctgagttcttggttctggtgtgaaaaaggaagaaaaatattatggcaacatgggaactttcagggaataaagcagatatagatatggtatcaaagtagggaaagggtatacaggcccaggagccctaggaggcaaaagaaagggagttaataccatgccaaagacaagcttgctatctttcaaaatatcgcctcctgtcagtttcagcagaaagaaataaactttcttctcagtgacctaggctactttgaggcaaatcattttgagttccaaacaacccatttaataaactttaaataattattactaaaggtaggatactgcttataatgctcacttatattttctctataactgatagcctgtcctttttgggtgggtgggggcgggggcggttatggacaagacaaggaaccataaagatatctgggttaatgttttcttttatacgtttgtttttgcatgacatttaaatgacagagaattctaaagccaacactaagctgctatcctaggacattagtgagaatgctgtggccaaaatatagtgctcattcctcaggcttgaaaggaaccccacgtcgccagtgtgggagatcatttataatcttgatggatacaggtatagcctgcttcataataatttaatattcaacatcagatttttttttagtatgcctagcaggtttttagttactaattaactttattacccagatttgtttcttactgaacttctttcagaggcctgttatacatcaagctgaactttgtctggcagctgtgctgtttttaatttatttaaccacaaaaccttgatttatactttcaagcaaaatgatattttacttaaaaataaatctttagcaaggatgtctacaggaatcaactaccaacttacacagttcacagacacatatgattcctcagacaaatctgaatttctcctgcttctcctccaaaccagacttgcagatagcaacagacaactgaggaagatcttgactatcctgagcaataaactacaacccccctgaagaatatattaactgtccacccctaggttcctccctacacagttcaaggacaacagctgtgctattacaaactgatggaatttccaggcttgacagggttctgttcgtaaccaccatttgtcctgttcatcataggattagcaacagcagagagcccttgattactagaatagctgaggccatcacacagctacattcctacatgaaagaacacactgatataggtttaaagaagttatattttactttcatgtagttaccagagtcccccccaccccccatttaagggagccctgttctctggatataaaaatactgtatacacttgcacacacatactcacatacataaaaccttgcatcacaaagttaaaaggctaccttgcttacttacaggaactatccaggcagcttgtgttcagtcctgactaaatgcattttggatcaggcacctgccttcaacatttctgtccaaatgaatttcaatctatttctccaggaagaacacaccagatacctcccactgttagccatgtgatacaggcagcatgatgtctgaagtctggttacggttatgtaggccaaaataagaaatgacaatgacacagcacttacatttctgatatcaccaaccttaagaatgaatcttccattttatctaaattttttaaatgagtaaaactttaaaagattcttaatacctaacccctcaaaattttgaaaaaggagcattttttttaaactttacatttatcccacttccttcctctaacacaggaaaacattcagagttaatctataccaatccaaaaattatttctaaccacattctaaaggcattttttttttttttgagacagggtcttggcctgttgcccaggctggagaatgcagtggcatgatctcagctcactacaacctccgcctcctgggttcaagtgattctcctaactcagcctcctgagtagctgcgattgcaggcatgcacaccaccatgcctggctaatttttgtatcttcagtagagacgaggtttcatcatgttggccagactggtctcaaactcctggcctcaagtgatccacccatcttggcctcccaaagtgctgggattacaggcatgagccaccatgcctggctctaaaggcttacaccagttgaactgatctaggatccaatcccctcactttaatagatggaaaaaaaaatgagaaatggaaaaaacaagtcacttacaaatgaggctgagacaaaggatcggcgaaaagagccacagaacaccaaaaacagaagcagagcgtgacaaaataagcaaaaccttacagttttgtagtttctgcttttatctaacacaatgacttcgctgtacttcatataccttttgaattatacctgcttatacatacctttacctacctactacttatacctacctatcttttcttctgcaaggagggaggcaggcaggaagaatcctgaacatcaggaaaacattccacctgatctttaaagggaccccaatgcctagatgtctttttcttttttctttttttttttttttgtaaatccaaactcttacgtgtaatatcaaggctgactgacaagactcagtcctatcacccaccataatcatcagcagctttccatgtagggtctccctacaatttagtcacatgggaccatctaccatcttacattatcactgtacaccctatgctcatttgctctccaaacttgaagttatcttctctccctcctcatttgtgaaagtcttgaaatcaaggtccacataaattgtcttaccaccttttctgtgactgctttttagaatctttctcccagtagtattcagaactaatacatcatctgtacttgtaacagtagagtctgatctatactgtagttcagtggtccccaaaccttttggcaccagggacaggtttcgtggaaaacaatttttccacagatagcaggaggggtgagagggaggagatggtttcgggatgaaactcttccacctccgatcatcagtcattagattctcacaggagcatgcaacctagatccatcgcatgtgcagttcacaatagggtttgcgctcctatgataatctaaaaccactgctgatctgacagaaggcagaactcaggcacacttatcgcaaagttaatgtaatgctgttcacctgctgctcacctcctgccgtgcagcccagttcctaactggccatggactggtaccaatctacagaccgagggttggggaccccccactgtagttagttgtatataccagctcctgtaaactgctgggtcccagaagagaggaccacatcaaagtgatgtgcacaccttctctgttcctagtagactacagaggagacaggccaaaatgataaaaaccaacaaaacaaggggctaaaaacacatttctaaaatgacacgatgaaagttattagaaattgaatctaatttgaaattaatcagaagttccaaaattacaaaaactcttcacaactagaaaaagaataaacagattcaaggctgaaaggttatcaccaattacaaatattcaccttggctaggtgtggtggctcatgcttgtaatcccagcactcagcactttgggaggctgaggtgggtggattatgaggtcaagagattgagaccatcctggccaacaaggtgaaacccctctctactaaaaatacaaaaattagccgggcgtggtggtgtgcacctgtagtcccagctactcgagaggctgaggcaggagaatcacttgaacctgggaggtggaggttgcagtgagccaagatcgtgtcactgcactccagcctgggtgacagagtgagactctgtctcaaaaaaataaaaataaaaaagaatattcacctattttcttccactttctaaacacagtttgtacaagagcaagcatgttgtctggaattatagaaagaaagccagtaaggagtaaccgtacgaaccagctctccatgctggtcatcttatcattattaggcatagcaataaaaatagctctctctgcttttagaaaagcatgacatgatgcaatgtggcaaaaacaaatattcaagatggtcgaccagttactggcctggcatggtgactcacacctgtaatcccagaactctgggaggccaaagcaggaagaccacttgagcccaggaattcaagactagcctgggcaagatggcaagacaccatctctacaaaaaaaaatgtttttaattagctgggcatggtggtgtgtgcctgtagtgccagcctctcaggaggctgaggcagtaggattccttgagcccaggagcttgaggatgcagtgagctatgattacaacactgtactccagtctgggcgagaaagtgagaccacatctctgagggacagagagagaaagagagaaagatatcagccactaccatcatgttaatatgatcatataaatattaaaactttataattattaaaatattaaatctctatagttatcagctcatatatctgtcagaaagtaataagcatatcatgtaactttaggatgacttagtgctgaggagattggaagaaaggaagaatattcatacttgatcagctcttagcttttgagaactattttattaaagaaaaaactctcttttggctgggcatggtggttcatgcctataatcccaacattctggaaggctgaggcaggaaaactgcttgagcccaagagtacaagaccagcctgggcaacacagttgagactgcgtctccacagaaaacattttaaaattagcctgcacacctgtggtcccagctcttgggaggctgaggtggacggatcacttcagcagaggaagttcaaggctgcagtgagccgtgatagcaccactgcactccagcctgggctacagagtgaggccctgtcttgaaaataatagataacaaaagaaaaacttctcccattaagcaaagtgaagtttcactctattttatatcagtgaaaataaagaaaagtggaaggtagaagaggacataggaatttgtgctgccaattctataatttttgttttgttttgttttttgtggggtttttgagacggagatttttgtatttttagtagagacagggtttcaccatgttagtcaggctggtcttgaactcctgacctcaagtgattcgcctgcctcagcctcccaaagtgttgggattacaggtgtgagccaccatgcccacccttgtaattgtttatttacaatgtgtgtcccacccagagttccccttaacgcttgagttcctcgatggctaggatagcatctttctcaccttttatcctggacatctaaatataataaacttgaaacctcacaggctctcattaaatgcacatttgtcctgctaggtgcgctctgctccataccataccagccttctcttgctggggttgatgtttgcacagctggaagcaccctcatagttcttctaagtattggttctaggcacgactaagggtagagtagctcagcttttctgagcaagaaggagaagatacaaactctatgggagtacttaacaagcattttgtagtcgtggcaaaggccttactttgacctaatatcttacagatgctttcaaaaaggagggggggaatatcattattaaatgaaaattgaacagcaaaagttgaagagatctttcaagttattagtaacataacttttaatattttacctgaaatacaagtaaaaatctgaattaaaagtattaaaaaaacaaaaaaaacacgctggatcagaattgttcagggacagggttaagcaatatgagtattatttgttgttgttgttttgttttttttagagacaagtcacactatgttgcccaggctggagtgcattggctagtcacaggtgtgctcattgtacactacagcttcaagctcctgggctcaagcgatcctccagcctcaacctcccaggtagctgagactagaagcatgtgctactgcaccaaaaatctcagtgttgttggttttcttgcagtaagggtaatcatgacacagagaaatctcattaaagttgagtccgagaggcacccacaattgagggtcactgaattaatcaacaatctacctaatccattcaagataaaattcactgaaatgaaatgcaacacaggattaatacaacttaacaatagaaagacatcacactcccccttgttaggaaggtgttttagaatcagtttactagatgtagaatctgaggcacggatttttgtacaagtgatttactaagggagtgcttttaggaaaaacctataaggttttattttattttaaggttttatgatattttaaaggtatcaactatccccaaactaatctatagtttttgtttgtttttgtttttttttttagacagagtctcactctgttgcccaggctggagtgcagtggcacatgatcttggctcactgcaacctccgcctcccaggttcaagcaattctcctgcctcagcctcctgaatagctgggaccacaggcgtgcgccaccacatccggctaatttttgtatttttagtagagacagggtttcaccatgttggccaggctgttctcaaactcctgaccttgtgatccacctgtcttggcctcctaaagtgttgggattacaggcgtgagacaccacgcccggcctaatctatagatttaacataaccccaagcaaagtccagtaggttttttcttttcaaatcaaactgaaaagttgatcctaagttttacatagtaatttaaaaagtcaagaacagctaagataatctttgagaacaaacttagaggaacttaaactactggatatcaaaacttactgatggattgaaccatgtgaaaatgctgaaaactgatgagtttctaacctatggcaatgtcatatgtttgaaactaaaaatacataaatatagtaatgaaaacattgtggtacctgcacaatcaccaagaaagaggccaatgtacttggtgtgctgaacatatggaaaaacaaaacaaaacaaaacaagaggccaatgcaaaaaaatggttttgaaacggaaccacatgcatatggatacttaatatctgacaaatgtgacactgcaaaatagtgggggaattaactgtcttttcaataagtggtgctgggtcaactggatattttgagctctacctcacagtatatacaaaaagtaattccaggtggatggcagccctaaatgtgaacggtaaacaataacatggcgaatattttcatgatcacagaggcagatgaagaaaacgaacagacaatggagagagtagagagacagggacaaaagaaggaaaaaagaaaagcaaaaagaagatgatgaggtgggaggatcatttgagcccaggaatttgaatacagcctcggcaaggtggcaagaagggagggagggaaattcccctcagcagtacttaccaacttacaagaaacagatgggcttatttctaattgtaacactaaatgattttttttaaaaaatgaagtgatgcctttaaaactgagaaaaactattttgaagctagatttttacagccaactcatccattaagtgaaggctaaaatgggaaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagtgacactccatctcaggggggaaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattatatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctctaagtctgcatgtgctgacctttaaaagacagtataaggtttgtctgttttcccttctgctagcaggctgctagactgaacatggtagacaatgactttccctctgaagttggctgtgttcaatattctattgtttttcttatacaagcactgggagatttttgcaattgatgtatttttaatcatttaaaactaagcaagccatgacaatataaaagacaaacttacaccacaaatgaaactactaacaaaaataacaaatatactcatctggggatggcaggggttggggggagaccctctcctaaacatagcaagcaccaaagggctgctttgacttgcaatactaaactccttccaagaaatttggaagtaaattcagagtaaccaaagatacaaaaagcaatatgcaacaggagaaagtatttgggtgtgaataaagaatcaaaaaatgggccaggtgcagtggctcacgccagtaatcccagcacttggggaggccgaggcaggtggatcatgaggtcaagagatcgagaccatccaggccaacatggtgaaatcctgtctctactaaaaatacaaaaattagctgggcgtggtggagcgtgcctgtagtcccagctactcgggaggctgaggcaggagaatcgcttgaacctgggaggcagaggttgcagtgagctgagatcacaccactgcactccagcctgggcaacagagtttgactctgtctttaaaaaaaataataaataaaaaaattttaaaaatgtacaaaatgaaagggaccgtggcaaagatggggattctgtttcttctccctgggtgctcagaaagacatttcctatttcccttggagttagaagttgagaccatgtgagtgggttctagacagtgcaatgtgagctgaagaattatgcttcactacaaagcacttgatgaaattctgcttgctggtgctctttgctatcaaccaactaaatacaaagaatccagcaggagactccaagacaccagatggaaggagttgaaattcctcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcacaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgatttcatatggcttgacttaatagtaaatgacaagcactgcatttttagaaagcgctaattttattaggtatacatacctacacacttttttttttttttttttgagacagagtctctgtcatgcaggctagagtgcaatggtgcgatctcggctcactgccacctctgcctcctgggttcaagtaattctcatgcctcagcctcccaagtagcgggcagtacaggcgtgcatcaccatgcccagctaatttttgtattattagtagagacgggttttcaccacaccgggcaggctgatctccaactcctgacctcaggtgatctgcacacctcagcctcccaaagtgctgagattacaggcatgagccaccatgacatctttttacaagaagaaataatatgctgacttggccaggtgtggtggctcacacctataatcccagcactttgggcggtcaaggcgggcagctcacctgaggtcaggagttcaagaccagcctggccgacgtggtaaaaaccctgtctctactaaaaatacaaaaattagccaggcgtggtggtgcacacccataatcccagctactcaggaggctgaggcaggagaattacttgaacctggaaggcggaggttgcagtgagccgagatcgtaccactgcactccagcctgggctacaagtgcgaaactctgcctcaaaaataataataataataataataataataataataacaataataataatatgctgacttagaggctcctggactattgtcattagaactataaagcaaagtctatacatctgaagagaaatttcttttaaatatactcttctcctgtgtccttactgctttgtattaccttacaaagaaactactacatatacaatttcagctaatgaacataaaggatcaaaattagtgactattaggccaaatgttttggccaaaattgttgcaattaccatgtaaacataaatcctgcttgcctattattccatcagtttatacttccacttaatcaaggatttaagattgagtttgccttgtcaggctcacagaggcttaaattacttgtaaataaacattcccacaagagactacatcataaacgctcatatttattacatcccactcaaatacaacagtttctcttttaaaaattggcaatctatacaaaacagcaatttagattggccttcaggacagagaggtatgattcttagtaaatcacattacatcaagatgctttattctgaagatgtaagaaacgaatatatttttacaaaaacactatatgtcaagtgaatatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaataatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctattcccaaagcacttaagactagtaagacttcctgaagtctccaactcataaatggtcattgtttcacagctcaagtaaatacatgtatgaacatgtaaaataaaaaagagtaagggagaaccttaaattctccagtttactctcaaattttaaaactcagaaaagagagatccaaagtggtttccctttgccaaaagccatctagaaaactagagacaaagctacaattaggacaaacatctcccaactcccaccaagcccagagttccctccccaaaatgaatactcactgaacccacaagagaagcaccagttcagagtgcaaacctaggtcaaacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatcgtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttgggaggccaaggtgggcagatcacctgaggccaggagtttgagatcagcctggccaacatagtgaaacctcatctctactaaaaacacaaaaattagccaggtgtggtagcacacgcctatagtcccaactacttgggaggctgacgcaggagaatcactcaaacccaggaggcggaggttgtagcgagccaaaatcgcaccactgtactctagcatgggcaacaaagcaagacaccatctctggggggggagggaaatttgcaggagtttaagtacgacacagctgcactaaagctatttaaatcaacatcaactctaaacatttcttattggtagtagaattttggctgggttttagtggcttggtttaactaaatcacaaagtcagtagacaggaaaggtgtgagagggagagaaatggaaaacaaaagtaccacaaaatggctgggcacggtggctcacacctgtaatcccagcactttgggagggtgaggcaggtggatcacaaggtcaggagttccagaccagcctggccaagatggtgaaaccccgtctctactaaaaatacgaaaattagctgggcatggtggccggcgcctgtagtcccaattactcaggaggctgaggcagagaactgcttgaacccaggaggcggaggtggcagtgagccaagattgcgccactgcactccagcctaggcaacagagtgagactccttctcaaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaacccctgcctcgataaaaaatacaaaaaaggttagctggttgtggtggcacacacctgtagtcccagctacttgggaggctgaggtgtgaggatcactggagtctgggaagttgaggatgagtgagtcgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctgtctctactaaaaatacaaaaattagccaggcgtggtggtgcacacccataatcccagctactcgggaggctggcatgagaatgcttaaaacccaggaggcggaggctgcagtgagccgagatggcgccactgaactccagcatgggtgacagagcgagactctgtctctaaataaataaataagtaaatgcatatttttttaagtcttacttccctaggaagcaataatcactaactcctttttcagttttgtcaatgacctgaaaagcttggtcctgacacctctgctttatggaaaaggcaagaatgcatactgattcctaaggtagtaatctgaacggtttaaaattccatacatgtagctacagacaactagtataatggcagagatcttacatgatattttaagatctagttccagtagtaataaaatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaatatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttcaggggacaccccagtaaagcaacagcatacctcacacccagatgctggtttctaataccattctctgataaagaaaccaagactctttggagaaatgactaattctaggactgagaacaaaatattcaagatgagcctgaagtaccttgtatttccagaaagttaggaagtgctaaaaataaaaataaaaaaaaaaaaacaacgataggggtaagttggccggacgaggtggctcaggcctgtaatgccagcactttgggaggccaaggcaggcagatcacctgaagtcaggagttcaagaccagcctgaccaacatgattaaaacccgtctctataaaaaacccaaatattaaccaggcatgatggtgggtgcctgtaatcccagctactcgggaggctgagacaggagaattgcttgaacccaggaagtgtaggtagcactgagccgagattgtaccactgcactccagcctgggcgacagagtaagactccatctcaaaaaaaaaaaaaaaaaaaaaaaaaagataggggtaactcaattacacaggagtcaactaaaaaagttcccaatgaccaaagctggaacaatataaacaatagactgaataaataaatgagagagaataagcaagtcttcagtgaagaattccaaacaagatactccacttccaagaggtagaacataacccttcatcctttacatgtgcatagcacatagtgacctccttctaaagagtacaatatgaaaatgggaggggggggtaagagaaatatgacaaatactacctaagccaagtgatcaagactaatatcaatagtgataaatcagctgggtgcaatggcttacatctgtaatcccagcactttggcaggccaaggcaggaggttcacttgaggccaggagttctgacaccaacttaggcaagcaacatggcgaaaccccatctctatgaaaaatacaaaaattaggctgggtgcggtggctcacacctgtaatcccagcactttgggaagccaaagtagggggatctcaaggtcaggagattgagatcatcctggctaacatggtgaaaccctgtctctactaaaaatacaaaaagttagctgggtgtggtggcacatgcctgtagtcccacctacttgggaggccgaggcaggagaatcacttgaacccaggagacggaagttacagtgagccaaggtcgcgccactgcactccagcctgggcgacagagcaagactccatctcaaaaaaaaacaaaaaaacaaaaaaattagccaggcatggtggtacgtgcctgtagtcccaactacccgggaggctgaggtgggaggatcacttgggccctggaggccagggttgcggtaagccacgatcgtgccactgcaacccagcctgggcaacagagcaagactctttctcaaaaaaaaattagctgggcttggtggcatgtgcctatggtcccagctatttgggaagctgagttgagaggaagcttgagtcgagtccaggaggttccagtgaactgtgatcacagcactgtactccagcttgagtgataaagcaaaacacacacatacacacacacatacacacacacacacacacagacataaatcatgctgacatgatttgatagtatgcacccttgatataatgtgataagagtggcactttacctctgtgatcttccttctaaaaagcataacctctgtctaatcatgagaaaaagatcagacaactcccaactgaaggacactctacaaaatatcagaccagtactcctcaaaactgtcaaagtcatcaaaaacaagggaggtgtaagaaactgtcatagccaagagaaagctaagtatgataactaaacataatgtggtatcctagatgagatcctagaacagaaaaaggtatttaggtaaaaattaaggaaatctaaataaactatgaactttagttaataataatgtatgaaaattgaggtcaggagttcgcgagcggcctggccaacatggtgaaactgcatttctactaaaaaaaaataataaaaaaattagatgggcatggtggtgtgcgcctgtaatcccagctactagggagactcaggcaggagaattacttgaatctcggaggcggaggttgcagttagcccaagatcgcaccactacactccagcctgggcaagagagcaagactccgtctcaaaaaaaaaaaaattagccaggtgtggtggcaggcacctgtaatcccagctactcaggaggctgaggcaggagaatcgcttgaacccaggagacagaggttgcagtgagctgagattgtggcactgcactccagcctgggtgacagagaaagactccttctcaaaaacaaacaaaaacaaaaaattctagtaataaccattatttacttccaacttaaatctgatccacgacctaaaactgcactctgaaataatctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctccttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctatttaactatcagttatcgcactatgcttctacagttagtatctatgatgtgaaagttgaagccctggttaaagcttcttaaatctaccattttattttgtacaaacagaaaagtatattagttttctttccagctgtccttaatttttttaattgaagtgaagtttacataacatacaattaaccattttaaagtacattatgatttctctccagtttcaaactgtccttaagaatttttttatttttatttttaatttttttgaaacgggagtctcgctctgtcacccaggcttgagtgcagtggtaggatctcagctcactgcaacctccgcctccgaggttcaagtgattctcctgcctcagcctccagagtagctgggattataggtgcacgccaccacagccagctagtttttgtatttttagtaaagacggattttttcactatgttggccaggctggtttcgaactcctgatcctaggtgatctgcccgcctcaacctcccaaagtgctgggattacaggtgtaagccaccgtgtccagccaagaatttttaattaaagatgcactaatccaaatgtagatgagctactcaattttcagttaattaatcacatctgaagataatgatggcctatgccctcatatcaagtgtatcctgagcccttttatcattctaatctctttctacacgtggccaaccagagtgcatacatattgtgccaagtacctttcacctttttctacatatcagtagtattctatttcacagaaaactcacactcctgccctaaacataaccacagagttaggcttattgtgtggttagcctatctggcatgcctttgtctcacaaatgcttagaggacatttcacactacttagaaaggaatgatctcatcccactgacccaacagctaattttatcaaaaagctttttgttaaaagctgtgataacccaggaaaccagatctatttttacttttatggcaaggaaaaggaacagagaaaaccataaggaaaaaacagctcacacattgaccatttaaaaaaatcacttaggggcccagcacagtggctcatacctgtaatcccagcactttgggagcccaagacaggtgaattacttgaggtcaggagttcgagaccagcctggccaacatagtgaaaccccgtctctactaaaaatacaaaaaaagagctaagcattgtggcacacacctgtaatcccagctacttgggagtatgaggcatgagaatcgcttgaacctggagggggaggttgcagtgagctgagatcatgccaccacactccaccctgggcgacagagagagactctgtatccaaaaaataaaaaattttttttcacttaggccaggtgcagtggctcacacctgtaatcccagcactttgtgaggctgaggtgggaggattgcttgagtccaggagttcaagaccagcctaggcaacatactgagaccttgtctctacaaaatatacaaaaattagccaggcatggtggcacatgcctgtaatcccagctccttgggaggctgaggtgaaagatttgcttgagaccaggaggttgagtctacagtgagctgtgactgcaccactgcactccagcctgggagacagagagtgagacactgtcaaaaaaaataacttattctacagttttccccctttctttggtgtctgactacaagtgaacaaaaagaaaaactttcagaattgtttaatgcaagaaaaaaatcattattttaacaattaaaaagcaaacttcatattacagtccaaacactaaacctaccttgggtctgatttgtatgaaaaaaaaaaaaaaaaaaggatttctctccaataagaccccaagaaatatacaagtcttcagtgggagatgcaatataataaaatgacaaaatattaaaattgaagaagaaaaaggaaaaaaaaaaaagaaactccaacccatataaaaaaataagaactagaccagatgcagtggctgacacctgcaatcccagcactttgggaggccgatgagggaggactgcttcagcacaggtgttccagatcagcctgggaaacatagggagatcccgtctcaacaaaaaatttaaaaattagccaggcatggtggtatgtgcctgtggtcccagctactcaggaggctgaggtgggaggattgctggaacccaggaggttgaggctgcagtgagtcgtgatggcaccactgcactcactcaacagagtgagatcctgtctcaatagactaaaaataaaaataagaagagccagctgggcattgtggctcacacttgtaatcccagcactttgggaggccaaggcaggaggagcacatgaggtcaggagttcgagatcagcctggccaacatgatgaaaccccgcctctactaaaattacaaaaattagccaggtgtggtggcacacacctgtaatcccagctactcgggaggctgaggcatgagaattgcttgaacctgggtggtggaggttgcagtgagccgagatcccaccactgcattccagcctgggcgacagagcgagactccatccccccctctcaaaaaaaaacagcagttattgcagacttatattccagagaccattctaatcactttacataaattactttgcttaatatgttgaacaactctaggacatagataaccccatttaaaatgaggacaccagggcacttagaggttaaataacttgcctaagattgctcagctagtaaagtggcacaactcttaatttactaccaaatattgtctctcacagcaatctttatagcaagctctatgcaaagcaaaatgatcattcaacagactgaaaagtcaaaggctatgataatagcctttaacaattgaacactagtttaattgtttataacgctacctcccaccttttccacccacagccacccaatcccatccaggctgggtaaccagttagctcccttcaccaacaccactaccgacctgaccctcaaatgtaacacgtgaaactgccacacattaagcattcatctcctattaactttatgcctcctgttttttaattcttaaaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacacttaagaaacacaaaatagatcaagagcactgtttagagtgaatctccctaagtttatatgtatcaatcagtatgcatatgaaaaccaaatgagtgaaggcggctgatgtaaacaaaagagcctgcaacaggcaaacataagcaatgaaagctaatatagtatcttctggtgtgtagaccagctgtctgactttctaatggtgaatgttagcctacagtaagataaaacaaaagatgactataaggctgagagataaagactaaaatgaggttactggcttacagcctgaaaagtattctgaagccaaaaatcagatacagaatttggacccctatgaaatgcataaggctctccccaaatctcaactacacctccctaccctgtcattgattcttagtgggtcagaatacattcagtaagaatactagcatcaacatgaaataaaatctaaaaaggaaataaactctagtaaataaagttctgaggaaagtaaaaaagggtccctccaagaataggaaaagctgtcacaagaggtacagaacctccctttagctcttcatgtgctggattgatcctatatactcaaaagctgcatcagaatgagtaacatatgaataagagtggataagaatactaaatcaaaaatgatttatatcaattattgtccatcttcaatactaaaataattctttcacgcttaataattaaaatgctattcttcttctccaccttttcactttatttatttatgagacagggtctcattctgttactcaggctggcgtgcagtgacacaatcttggcttactgcagcctcgatctcctgaggctcaggtgatcctcccacctcagcctcccaagtagctggaactccaagcacatgccaccatgcctggctaatttttgtattttttgtagagacagggcttctccatgttgcccaggctggtctcaaactcctgggcccaagcgatcctgtcaccttggcctcccaaagtgctaggattacaggtgtgaaccacagcacccagcttcaatattttcagtacctacccctcaacctacctccatccctatgaaagtcgccatgacttcaggagcactctatatgatatgtacttctagtacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccactctgttgcccaggctggagtgcagtggcacgatcttggctcactgcaagctctgccttccaggttcatgccattctcccgcctcagcctcccaagcagcggggactacaggcgcctgccaccacgcccagctaattttttgtatttttagcagggacggggtttcaccgtgttagccaggatggtcttgagctcctgacctcgtgatccgcccgcctcggcctcccagagtgctgggattacaggcgtgagccactgtgcccggcctactgaaatcttctattccattatcttctagtgttgttttgcttttaagagttggctgtaggccaagggcgatggctcatgcctgtaatcccagcattttgggaggctgaggtaggcagatcacacgagcccaggagttcaagatcagcctgggcaacatggtgagatccagtctctacaaaaaatacaaaaattagccaggcatggtgatgcacgcctatagtcccacctatttgggagggctaagataggagaattacctaagcctggggaggtaaaggctgcagtgagccgagatcataccactgcactccagcctgggagacagagggaaactctgtctcaaaaaaaacaaacaaacaaaaacagcaacagaaaaaatagttggcagtgagtcataatttgaaaaatttcagtcctggtaaaaaccaatctcttaacagaaagaggtactattaaaactggttttcagttttccagtgctgacgatcccctcacgagaacaggcctctcacaaagaatctccctccctctccagaaaaaaagagcaagcacaagaagtgcctggtgcagagccccaattcttacttcctgaacgtgaaatgcccaggatgctataaaatcaccatggtcgtcagtcatgcacaatagtagttgtgtgtctggctgctctgctgtcctctgccagcctacaggaaggctctccttcagatagagacagcactgaaagaaccctgaatcaagatgagtgggaaactatatcaataaacacatatggatgccaaaaataaataaaagtagttttcaaactttaacgtggacatcccatggaaaggtggtttaaaagagattatgaagttctattcccagaatttgatttagtaaatctgggtaggagtccagaaatctgtattttaaagcagtccaaatggttctgatgcagatgataaaacaatccttatcagaaacatgcttacataatttaagatttaatctcaaaagtcatagcttgaactcttcttgcactaagttaaaggttaaacaaagtatctgcaagaggattctgtcctgctaacagactggtttttaatctgaacattgtttggctcaacagtcctttcatagacttcctctaaagcaacttggtaagccactaaaatctaactgttcctcttaactacagccctttgcaccaagaaaacagaagaatgatataaatgaaaggcatttctgttgcccagtcattggctctataactgaaagggcttttgaaaaccagtcacattgactatacaagtgacatatgcagtcatcagtttggaatctctaaggactacagctcaaaaacaatcactaacagctcaaagtctgaccccaaagtgcttaaaagccattgatgaaataaagccttcataagaacattctacaatccacgcttctactccttgctattacaagccaataggatcttaaggttttaaatttgacaaaatcatattatttatttttatttttttatttttttttgagacggcatcttgctctgtcccccaggctagagttcagtggcgtgatctcggctcactgcaagctccgcctcctgggttcaggccattctcctgcctcagcctcccgagtagctgagactacaggcgcctgcagccatgcccaactaatttttttttattgttagtagagatggggtttcaccatgttagccaggacggtctcgatctcctgaccttgtgatccgcccgcctcggcctcccaaagtgctgggattacaggcgtgagccaccgcgcccagcctatttatttattttgtaagacagagtctcactgtcacccagctggagtgcagtgccgcaacctcggctcactgcagcctctgcctcccaggttcaagcaattctcctgcctcagcctcctgagtagctgggactataggcatgcgccaccacacccagctaatttttgtatttttagtagagacggggtttcaccaattggtcaggctggtcttgaactgctgaccttatgatctgcccgcctcagcctcccaaagtgctgggattaaaggcgtgcgtgcgccaccacatccagccaatttttgtatttttgatagagacggggttttgccgttgttagccaggctggtcttgaacccctgacctcaggtatctgcaagccttggcctcccaaagtgctgggattacaggtataagccaccatgcccagccaataaaattgtattttaaatgcaccaagtacctgcgtcaacaatccaaaaatgatattaagaaaacaattctgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctcccaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaaccccatctcagtctgggtgatgcggtgcgaccctgtgtccaaaaaaatacatgaaaatcacaccaagcttctttgtagaaattgacaatcaatcctaaaattcatatggaaattcaagggacccagaatagctaaaacaaccctgaaataaaaacaaggttgacggacacatactttccactttcataacatactacagaaagctataatagtcaagacaatgtggtactagtataagcacagacaaagtcctgggagggtagcacacccgaattccaccaggagagatgctcctgctctcaggacctttccagaccttgtcttatatatctcttcagctggctatttatgtgtatcctttaaaatatcctttgtaataaactggtaaacatgtgttttcgagttgtgcgagctgctctagcaagttaagcccatggctataaatgggaacaccaatttatagccagtcagtcagaagcacaggtaaaataagcgggagcttacaactggcatgtgaagtgtggggagaggcagtcttggaaactgagccctcaacctgtggaatcttgatgctatctccaggttgattatgtcagaattgagtggctgtcagctgcagaaatgactgcttgcttgcctgctggtggggagaaatccccacacatctgctttcagtagggtgctataagaatatcagcagtaggagaaacggagtttgttttttccacacacacctgtatctaaaataccaaaaactctggcaacttaataataaaaaggcaaattaatttaaaaatgaacaaagaatctgtacatttctccaaagataatatacaaatggccaataaacacattagtcaccagaaaaatgaaagtcaaaaccacaatgagatcctacacccagtagcatgactaaaataaaaaaaaacaggtaatgaatggcaagtgttttagatgtggcaagaactggaaccctcatatactgctaatgagaacataaaatggtgcagccaccttgaaaaagtctgggagctcctcaaaagattaaacagagttaccatatgaaagcagaaataacccaaatgttcctcaacaaataaatgataaataaaatgaggtacatacatacaatggaatattattcagccataaaagggaataaagtcctaatacatgctacaagatgggtgaaccctgaaaacatcacaaaagaccacctactatattaatctgtgtatataaaatatccagagtaggtaaatttatacagaaagtagattcatggttgcctggggcttggggtttattgtattagggagtgataaagaacatgggatttcttttgggggtcatgaaaatgttctagactttactgcactaatggtgcacatgtctgtgaatataccaaaaaacaatgaattgtacattttatttatttatttattttttgtgatggagtcttgctctgtcacccaggctggagtacaatggcatgatcttggctcactgcaacctccgcctcctgagttcaagcgattcttgtgcctcagcctcccaagtagccgggattacaggcacgtgtcgccatgcccggctaatttttgtatgtttagtagagacggggttttgccatgttggtcaggctggtctcgaactcctggcctcaagtgatctacctgcctcggccttccaaagtgctgtgattacaggcatgagccactgtgcctggcctgaattctacactttaagtgggtgaatggtatggtatataaaatatatctcaacaaaactgttaccaaaaagagagataacaccaaacacatgaaacttccttcctatgagattattcttaatactagctttaaggatatttcctttttgcattacttttagaatattttctacaaatattattttcagtcagtccaagttttttaaaagcaaaacttgtcaaaggaaacatactttgttagagatgcatatacaaactctgcaaagaaaaggctagttagggggtacccctaaaaactaagaagaaaaattaaactttccacagtttacaaacaggcagctttcattttacacaatagtgcaaaaccgtaaaagtaagaatgcacgctgaaaccatgcaaagtgatcataataattaatgagaaaaactgcaattgctctgtaatctttttttttttaaaattgagacggagtctcgctctgtgtccagtctagggtgcagtggcgcgaccttggctcactgcaatctccacttcctggggtcaagcgattctcctgcctcagcctcctgagtagctgggactacaggcacgtgccaccacacccagctaatgtttgtatttttagtagagatggggtttcaccatgttggccaggatggtctcgatctcctgacctcgtgatctgcccacctaagcctcccaaagtgctgggagtacaggcgtgagccactgcacccagccgctctgtaatttttttttgtttttgttttttgagacagtctcactctgttgcccaggctggagtgcagtggcgcaatctcggttcactgtaagctccacctcccaggttcatgccattctcctgcctcagcctcccgagtagctgggactacaggcacccgccaccacgcccggctaatttttttgtatttttagtagagacggggtttcaccatgttagccaggatggtctcgatctcctgacctcgtgatccacccgcatcagcctcccaaagtgctgggattacaggcgtaagccacagtgcccggccgccactctgtaatttttaaaaaattttgggccaggcacagtggctcatgcctgtaatcccagcactgggaggccgaggtgggcagatcacttgaggtcaggagttcgagaccaccctggccaacatggcgaaacctcatgtctactaaaaatacaaaaattagccaggggtagtggcacacgcctgtaatcccagctacttgggaggctgaggcaggagaattgtttgaacctaggacgggttcactacagaggttgcgtgagctgagactgcaccactgtactccagcctaagtgacacagtgagactccatctcaaaaaataatttaaaaaataaaataaatattacccaggggtggtggtgagcacctgtaatcccagctactcgggaggctgaggcaggagaattgcttgaatccaggaggtagaggttgcagtgagccgagatcacactactgcactccagcctgggcaacagagcaagatcctatctcaaaaaaaagaattttttttttgttgaggccaggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctctgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaaactgtcttccactaaatcagtgctaaaaaggttgaggaccactgcactagagaacatagaaatattgaaaattataatgtttaagttctttgaaaaaatttattaggggtagtttaaatagtgcttacattcttctcatcatacaatagagacggggtttcaccctgttagccaggatggtctcgatctcctgaccttgtgatccgcctgcctcggcctcccaaagtgctgggattacaggcgtaagccaccgcgcccggctgcaatagacatcttttctatgccttagccaattgtcacactcctgtctgagtctggaatagcatcaaatactttatgtttcatatttcaatatcacagaataccttcgagagttctttcactacaaaatttcttgcatcacttcttttttttttttttttttttaccaaaccactttcttcacttatgtagataagctcaccttcactaagttatttcggctacatatccagagtgttttgaatgagagcatcagcattccctcagtgatctatttcttctataactccatttgagttcaatttgaatttcacttccactgttgttactttttggttttttcctgaactttcatctttttcggccaattctctctatcggttatcgatttttcttaactatcacatagatttatcactgggagacaaggaggtaacacaaacccatgctttgcacagttgttacttatgtagtgacagaagagctggcagcgaattttgtactttatacgattattcacagttaatatgctgtgtaaaatttaaaccatgttattagggaattggtattatttaaccaaaccatggtaagtgaaagtgtatatgagaaccacataaagcaacaactccctgtatatcacatcacaaaatcacagaacttaaaagccttcttcacagtaatctagccacagtgtgtatgtggacccttgatgtagtattaatgacccgtctacttcctgcctgaccatttcaagtgatgcccacattacttcacagggtggctctttcattgttgaacacttctaacagttagaaaaataaagcccccagctagtataatggtcaaaagcacaggttctaaaatcagaccacctgaattcctatcctttcttttcctctgttgagctaggtaaatttgggcaaggtatgtaatctctccatgactgtttactcatctataaaataaaaatgttagccgggcgcggtggctcacgcctgtaatcccagcactttgggaggctgaggcgggtggatcacgaggtcaggagatcgagaccatcctggttaacacggttaaaccccgtctctactaaaaatacaaaaaatgagccgggcgtggtggcaggcgcctgtagtcccagctactcgggaggctgaggcaggagaatggcgtgaacccaggaggcggagcttgcagtaagccgagaccacaccactgcactccagcctgggcaacagagtgagactccgtctcaaaaataaataaataaataaataaataaataaataaataaaaatgttaaggccttcaatcatgaagttgttatgagggatggcaagtgttcagtaaattataacctatataatttatcatattatcatcatcgtctgtagagtgcttagtcttccttatccatccccatgtactttggttcaaacccctcacctagattctgcactagactcaactgaacactgacagtctctcacccagttctccatatggtcaccagaattatctctctaaaaataaaatctgactccggtcagcataaacaatttagcctaaagccatcaggtagggtagagcaagcagagcaaaatcagagtcttcgtttaggggtggggaggaagccatggtggctgaaagcagggtatcaaataccaagcaaagtggggagggaattcatgtggtaaggtggcctggcccaacataacttataaggagtcaaaagacggctactattttaaaaagatgacatgaaacctacaaattgaggaaacacaatagtccaagagggaaagaaaacccaacatctgtcaagtagacacaattacttactttaactccatgttttcttgtttccttgtaaacacatgggtgttttggtgttcgttcattttgttattttcttagcactggttttcacaaaattcactttcggaataaaatttcatttggaatgatgtctctcttgaatttgtcaacaaaaggaaactcctagtgatgcctcatcatcagctacacaaatatttggtatttgaaaaaatgctggttctttaaaaaacacatttgtggttctctatcacttaaaaaataaagagacagagagagatgtttggcacagtgacacacagcctatagttccatctacttggaaggctgagacagaaaggattgcttgagtccaggagttcaaggctgcaatgagctatgattatgcctgtgaacagccactgtactgggcaatgtatctagactcccatcttttaaaaagagagagagaaagagaaagtacaaaagagaaaagaaaatgacaagaacaaagaaaaaagcagacaatattaactgtgaatctaaaataggttgtagagctcctcctgatgctgtaacctgatcatggtgcacactgataagctcccattacaacataagaaagccacagacaatggagcaagtcatcaccttccttgtattacaatctcatgtccttgctttggatgctgtgcctcctaaccacacctagtaaaagtagcatcacttatttggcaacatctagtatttaagaaccaagtaaaggcctgaaaggaattaccaggcaagactggatggtactgtgcaaggaacacacactttatcatcaggtagatccagatctcaattatcttttttttttttttttttttttttttttgagacaaagtcttcactctgtcactcaggctagagtgcagtggcagcgccaaggctcactgcatcctcaacctccaggactcaagtgatctcccacctcagcctccagagtagctgagaccacaggtgcatgccgccacactgggctaattttttaaatttttttgtagagacaggatctcactatgttgcccaggctggtctcaaacattatgacactgatacataactgttaactagactacagaccttattcagttttcactattttttttaacctgcatttgtgtgtgtatttctaagcagttttgtctcatgtatagatttttataaccacaactgcaatcaagatacagaactgttctgctacctctctgtatttatagcccctccacctactacccccctgtcccctggcaatcactaatctattcttcatctttacagttttgtcactttgagaatgtcatataaatggaactatataatatgtgacctcttgagataagcttttccactaagcacattacccttgtagtctattcaaggtgttgcaggttatctatagcttgcttgttccttttgattactcagtagtattccatgctatggatgtcatatgttttgctttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtctctactaaaaacacacacacaaaaaaatagctgggcatggtggcgcgtgcctgtagtcccagctactcgggaggctgaggtagtagaattgcttgaacccaggaggtggaggttgcagtgagccgagatcgcaccactgcactccagcttgggcaacagagtgagacttcgtctgggaaaaaaaataaattaattaaattaaattaaaaatttttggccgggtgcagtggcccatacctgtaatcccagcaatttgggaggccaaggcgggtggatcaccggaggtcaagagtttgagaccagcctggccaacatggtgaaaccccgtctctactaaaaatacaaaaagtagctgggcgtggtggcacacacctgtaatcccagctactcgggaggttgaggcaggagaatcgcttgaacccgggagccagagattgaagtgagccgagatgacactactgcactccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttctcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgcggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccagagtttcttaacaccttcactactgaaattttggacaagaaaattgttatgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctaggagttgtgagtgcagggaaatggaaggattaggtggaagagtagctaaggagaacagggtgggtttttttgtttttgttttttgagacagagtctcgctctgtcgcccaggctggagtgcggtggcgcgatcttggctcactgcaacctccacgtcctggttcaagctattctcgtgcctcagcctcccgagtagctgggattataggcgtgcactatcacacccagctaactttttgtattcttaggaaagacagggtttcgctatatcggtcgggctggtcttgaactcctggcctcaagtgatctacccgcctcagcatcccaaagtgctgggattactggtgtgagccaccgcgtcctgcctgagtaatgaaaatgttctaaaactgattgtggtaatggatgcacaactgtgaaaatactgaaaaccactgaactgtacattttaagtggctgaactgtatgttttataaattgtatctcaatagagctattctttttaaaattcagattctggactccactccagatctcataaattagaatcaaaagcagaaagccaaaactattctaaaataccttccaggatcactaggaggacatttggggttcacagccagacagtgatgaacatctcaaaccacaagatgcacagaacggctaagaggaaaatgagcttgctgtgcactacccaatggttaactgcttggaaaaatatggaaactgataacgtgttaaatatgttcaataacacatctcaaatttatgtctaagaacacatttcaatttcaactccatgttaagttgaaaggatagcttcccaaattatgacatatgtaccttcacctttaaagaaacagaaactaaaacaactccaaatattatatgcttttacatctacattcattcattaagtggttttataattactggttttgagttatactgcagctactcacatcataagaaaaagacaacataaagtacaagaataaacttgagtataatttttaattagacctgatgcatcaatctgaatagctaataccaaaaatcctaagctatgaaatctaaatttcccaataaatctgaacatctgcaagtataccacatagcaattagaaaaaactgtactatggaaaagatttaagtcgttctggtttctgttttgcaagttccagcagaaaactaatgctagggttcattgaaacaacactgctagtatctcctatttcctccaagaacaaacaagaaagccattattatctcaaatgttcttctgaaaagtataatgacccttcttataatattatggaaaatatgaacaagaattttaatcaaaatagcattcgtaaagccacatgaacacttttattttttttatttttaaactttaaaatctaaatacctacccaaatacccagtgtttctaaaactaatgactaaatctgatttacttctaactctctctagtatataagtgatgtctgaactatgagattcatgtgaaaatgtacgtcgtttatttgtacatgatctgtctctcaggcactcgacctaggggagtaacacatattgatgatctccagaatgtgcacattacaacctgattgataccaaattggtgctatattcatgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaagagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtgggtggatcatgaggtcagaagttcaagaccagcctggccaacatagtgaaaccccgtctctaccaaaaatacaataaagtagctaggattacaggtgtggtggcgggcgcctgtaatcctagctactcaggaggctgaggcaggagaatcacttgaactcgagaggcagaggttgcagtgagccgagatcatgccactgcacgccaacctgggcgacagtgtaagactccatctcaaaaaaaaaaaaaaaaaaaaaaaaaaaaattagctggccatggtggcgggctcctgtaatcccagctactcaggaggctgagacacgagaatcacttgaaacctgaaagcagaggttgcagtgagccaagatcataccactgcactccagcctgggcgacaaagcaagactctgtctccaaaaaaaaaaaagaaaagaaaagccccaacaaaagtcagtcttctttagctaaaagaccaagaaagtagcagtctagcaagacagaaaagttttagacaataaccaatctaccccagccaaacaccaagaaaatactgtggtttaaaacctacccgttctagcaaaggccaagtggggagcctagatttccaacctctcaaagctgtaattaagcactcaataccccttccaaggtggagacagaaagccaagtagggtatccaggaatttcatccctgcagaccagtaacaagatcagcggggaccacgtggggaacctgggcctccaccatattatatcaatacaaatggcagtttctttaaaaagtctccctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcgtctccgcccggcagccaccccgtccgggagggaggtgggggggggtcagccccccgcccggccagccgccccatccgggagggaggtggggggtcagcccccccgccccgccagccatgccgtccgggagggaggtgggggggtcagccccccgcctggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtgggggggtcagccccccgcctggccagccgccccgtccgggagggaggtggggggggtcagccctccccccggccagccgccccgtctgggaggtgaggggcgcctctgcccggccgcccctactgggaagtgaggagcccctcagccccgccagccgccccatccgggagggaggtgggggggtcagccccccgcccggccagccgccctgtctgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgacccgtccgggagggaggtggggggggggtcagcccccctgcccggccagccaccccgtccgggaggtgaggggcgcctctgcccggccagccgccccgtccgggagggaggtggggggttcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggaggtgtgcccactagctcattgagaacgggccaggatgacaatggcggctttgtggaatagaaaggcgggaaaggtggggaaaagattgagagatcggatggttgccgtgtctgtgtggaaggaagtagacatgggagacttttcattttgttctgcactaagaaaaattcctctgccttgggatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaataaataaataaataaaaaagaaaaaaaagaaaaaaaaaaaaaagtaagcatgcgactaccatatggcctagcaactgtactcctaggcaaactgccgaactatttttcagagtggctgtaccactttactgttaactgtttcaatgtcaataccctggttgtgatattgtaccatgattctgcaagaaatttccaccaggggaaactgggtaaagtgtacaagggatatctctgtattattgtttcttacaattgaatgtaaatctataattatctcaaaattattttaaaaaactgtgtttaaaaactaaattaaaaaacacaaatatactaaatatttagacttaaggctgaactatgagttacatatccttatatcccaagcacctacaccaaagcctagaacatattagacaataaatatttattgaattagattgaacatacaatcagcacttcaaaaatataagatgcttacaaacctaacagttccatttcgttggctgtaaataaagtaacaataccttaaaacaagtgcaaaaaagttaccttcaagaaaatataaagtattctggaattttttcaaagagaaaaatgactcagtcctagactacaatgacttagatattacctcattattttggctaatttattgtacggagagagggagggaggccagtaggccggctggccagcctgcgaggcttaaaaagtaccatgtacataatttaaaaattagcatatagtagggagtctttagaaaccaagtagcacacataaatactacacatacccacccacttgcaaaggtgttttaagccaaaaatcttactctacgtgtccaagtttcatcggtatttctgattttcactaggtctggctgaacaggattatgtcttatcttttagagtaactatcagaactggtgattatctccatcatctatgaacacagtccttttcatctgataaaactggcattcggtaacaagaaagcatcttattttaccagaatgacccaagtaattcattaattaaagaaaaaaatgtatacaggaatctttattgttgctttggtttgttggttttctaaaaccaataaaacaattgtcttttcctgcataaacacctgatttgaaaatctagatacaatattattttattttattttatttatttttgagatgaggtcttgctctgtcgcccaggctggagtgcaatggcactatctcggctcactgcaacctccacctcctgggttcaagtgattctccctgcctcagcctccgagtagctgagattacaggcgtgcaccaccacgcccggctaatttttgtatttttagtagagatgggtttcatcatgtgggccaggctgctcttgaactcctgacctcaggtgatctgccctccttggcctcccaaagtgctgagattacaggtgtgagccaccgtgcccggcattacaacattattttaaacagccttcatcattaagtaatgaaagtgaaagtagagtcagcagtcagtaaaaacactttgtgattgaataattcaagtacagaattaacagccaaaactacatgaactgaacagataatgataaaaacccaatcagggccaggcacagtggctcacaccttaatcccaacactttgggaggccaaggtggggagattgcctgagctcagtggttcgagaccaccctgggcaacatggtgaaaccccgtttctactaaaatacaaaaaattagccaggcatggtggcgtgcgcctgtagtcccagctacctgggaggctgaggcatgagaatcacttgagcctgggaggtggaggttacagtgagccgagatcgtgccactgcactccagcttgggcaacagagcaagactccatctcaaaaaaaaaaaaaaaaaaaaaaaaaagacctactcaggatagcaacattacaataatggcaagccatacttattttgatcctttatggtccatatgaacacatgaaatcttaattatttgagaattcaacaacttttgggctgggtgcagtggctcacacctgtaatcctagcattttgggaggctgaagcgggtggctcacgcctgtaatcctagcactttgggatgctgaggcaggcggattgcctgagctcgggagttcgagaccaccctgggggcaacatggtgaaaccccatctctactaaaatacaaaaaattagccggcttggtggtacacacctgtaatcccagcaactcaggaggctgaggcaggagaattgcttgaacctggaggatgcagtgggctgagattgtgccactgcactctggcctgggccacagagtgagactctgtctcaaaaaaaaaaaaaaacttttgaacatctctctcttaaacctctggcctttaaaatcccaatcatatcacatttaatatacatgggttattaaatgggttcaggaattgttagtctgcagtagaactctgcaacaaacaataaacagtttcatcaccaaaaggtacctggatgtaatctcaattagtaaaaactcagtcactcatatgtcactgacatatttcctttggacaaggcaactcattctgttgatctttctcagccactatgaagtttatcactcatgcctgtaaatggtacatggtcatgaactgctacagaataaagtccaagagaacccaccaaaactgtggaagattaaaagattgatggatcattaaaaaaaaatggattatagacctaaatgtaagatacgaaactataaaactcctagaggataacatagaagaaaatctaggtgacctagggtttggcaatgacttcttagatacaaccccaaaaacatgatgtaggaaagaaaaaactgataagctggactttactgaagttaaaaattctgatctgcaaaatacactgctaagagaatagaaactcaacagattgggagaaaatatttgcaaaacacatctctgacaaagaactggtatccaaaatatacagaggccaggcgcagtggctcacgcctataatcccagcactttgggaggccgagggagatggatcacaggagcccaggagttcaagaccagcctgggcaacgtgtcgaaaccctgtctctacaaaaaaaaaaataataataatacaaaaaaaatgtagccagtcttacaacccaatctcaaaataaataaaaaattaaaaacgaaacaaaatatacaaataactttttttatttttgagacggagtctcactgtcgcccaggctggaggacagtggtgcgatctcggctcactgcaagctccgtctcccaagtacacgccattctcctgcctcagcctcccaagtagctgggactacaggtacccgccaccacgcccggctaatttttttgtatttttagtagagatggggttttaccacattagccaggatggtttcaatctcctgacctcgtaatccacccacctcggccttccaaagtgctgggattacaggcgtgagccaccgcgcctggacccaaagagctcttaaaatttaatatgaaaatgaacacctccccctccccctccccctctccctctccctctctttccacggtctccctctgatgccgagccgaagctggactgtactgctgccatctctgctcactgcaacctccctgcctgattctcctccctcagcctgccgagtgcctgcgattgcaggcacgcgccgccacgcctgaccggttttcgtatttttttggtggagacggggtttcgcctgttggccgggctggtctccagctcctaactgcgagtgatctgccagcctaggcctcctgaggtgccgggattgcagatggagtctcgttcactcagtgctcaatgttgcccaggctggagtgcagtggcgtgatctcagctagctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcccggcagccgccccgtctgggaagtgaggagcgtctccacccggcagccgcccagtccgggaggtggggggcagcccccgcccggccagccgccccgtccgggagggaggtggggggcagcccccacccggccagccgccccatccgggagggaggtggggggcagcccccgcccggccagccaccccgtccgggaggtggggggcgcctccgcccggccgccaccccgtccgggaggtggggggcacctctgcccagccgccccttctgggaagtgaggagcccctctgcctgaccgccaccccgtctgggaggtgtacccaacagctcactgggaacgggccatgatgaggatggcggttttgtcgagtagaaaggggggaaatgtggggagaagatggagaaatcagattgttgctgtgtctgtgtggagagaagtgggcataggagactccattttgttctgtactaagaaaaattcttctgccttgggatgctgttgatctatgaccttacccccaacccggtgctctctgaaacatgtgctgtgtccactcagggttaaatggattaagggcggagcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccttctgcgagaaacacccaagaatgatcaataaaaaaaaaaaaaaaaaaaaaaacatcactatgtaccccatgactatgtacaattgttatctgtcaattaaaaataaaataatgtttaaaaaataaaaaaatttaaaaaattaaaaataaattaaaaaaaagaaaatgaacaatgtggctgggcgtggtggttcacgcctgtaatcccagcactttgggaggctgaggcgggcagatcacctgaggttgggagttcgagaccagcctgaccaacatgaagaaaccccatctctactaaaaatacaaaaaattagccaggcgtggtggcacatgcctgtaatcccagctactcgggaggctgaggaaggagaatcacttgaacctgggaggcgggaggttgttgtgagccaagatcgtgccattgcactccagcctaggcaacaagagtgaaactctgtctcaaaaaaaaaaaaaagaaagaaaatgaacaaccccattttaaaaataggcaaaagatctgaacagacacttcaccaacgatatacgaatggcaaataagcatatgaacgaaaagatgttcaataacatatgtcatcagagaattgccaattaagacaacaataattctgacaaccgtggttaaaagaaattattaataagaaaaaaagacttcaaattcattaaaaaaaaaaaagacaacaatgagatgccaccgtgtccgtatcagaatggccaaaatccaaagcacaacaccaagtgctgacaaggatgtcaaacaataggaaatctcattcattgctagtggaaatgcaaaatggtacagccagcaaggtgagctggaatcacctatagtcccagctactcaggacgctaagccaagaggattgcttgagcccaggagatgagtctagcctgaacaacatagcgagacctgtgtcttaaaaaaaaaaaaaaaaagttatacccagtttgggaggttcttacaatactaaacatactctctcaccacacaatccagcaattgcactccttgatatttacccaaagatgaaaactcatgtcaacacaaaaacctacatgtggacatttatagtagctttattcacaattgccaaaacttggaaccaactaggatgcctttaataggtgaatggataagcaaattgtagtgtacccagacaatggaatactattcagcaataaaaagaaatgagccatcaagccacaaaaagacattgagaaacctcaaatgcatattgctaggtgaaaaaaaagccaatctgaaaggctatatactgtataattctaactatacgacattgtgaaaaaggcaaaactatgaagacagaaagatattagtggttacagtagttaaggggaagaagtagggataaataggtggagtacaggggatttttagggcagtgaaactattccatatacatattattatgaaaccatctttgcaaaaattataactgagacaattattacagtgaaagagatctgatctaaccaactccatcctgcttctaacctcccagctgtccttgttcattcctagacttagcccaaactaactttgtttgggaggaacttagtttacagtttaggttagttttcccagaacaaacccccttcctggctggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaattatcctttaaaactccaattcacaaattctcggacagactgatttaagtaataataaaactctggtctcccacacagtcagttctgcttgaattactctttctctactgtaattcccatcttgataaataggttctgttgagccagcgggcaaggtgaccccgttgggtggttacaattagacagtcatgcatcacttaacaatgggaatacattctaagaaatgtgttaggtgacttcatcattgtgcaactgtcatagagtgtactaaacaaacctagatggtacagcctgctacacatctaggctatatggtataatctgttgctcctaggctacaaacctgtacagcatgtaactactgaatactgcaggcagttgtaacacaatggtaagcatctgtgtatctaaacatatctaaaaacagaaaaactaaggtgttatgccaagcattacatcactaggcaatgaaaaattttcagctccactatatagaaagtacccatctctacaaaaaaagaaaaaaaattgccagccttggtagtgtgcacgtgtagtcccatctactgtggaggctgaggcaggaggactgcttgaacccagaagttccaggctgcagtgagttatgatcgtgccactgcactccaacttgggtaacaaagcaagacactgtctcttaaaaaaaagaaaagtctattaattttaaaaaagaacctctgcacaatggaatgatcttcattctttatatactactgtaccacctcataaccatgactaacattactaataccactcacatctcaaacatagcaatctaactccttacaacttaaagtgtcatctgtagaccaacaggattagcatcaccttatagatcagaaatgcaaaatcttgggtcccacactaaaccttcagaatcagaatctgccttataaaaagatcatgtgatttgtatgcacactaaaatctatgaaggcctaatccaaagctttcaattcaaaggccacacaaggcaagggggacagaaatcaaggccctgggccctcccaaagttaagccttataagacaccccaccatatacctctccaatctaaaccaagccccaaatttttcactatccctagcggactatatagaagcctgccttggtgttgagcaaatcaaaagaataaaaaattcctgagaaatcatagccacgaggaatccctgtatgcactggcatcttagtttcttataatctggataagccaatgactgtcaagtcatgcagtttgaggaaataaaaaactagtgatgccacagagtacctgacagatattaacaccaaggctaacttctcaagcaacaatgtaagccagaagataatggaatgataagttcaaggctggacagggtggctcacacctgtaattccagcactttggaaggctgaggtgggaggattgcttgagtccaggagtttgagacaagcatgggcaacatagtaagaccccatctctacaaaaacaacaaaaaaagaaacgataaattcaataaactgaaagaaaataaaatgcaatactaataaacatacaaacaaacatacaatactatgccccccaaaaaagtagttttcaaggatgaaagaaaatatatacctatatagtatatccgtagaagttttctggggacagggtctttgctgttggttagattctcaaggggatatatactcatgaaattaagaaccatttatttacaaaaacattaaaggtcattcaacttaacttcctccccagtatctctaaataccctggctctgttttaacataagttaaactcagtatcttactttaacatgaggaaactcactatcttataagaaagttacattccatttttctctttaacttctacttgatggtccttgttcttttgtcaaagcaacaaaatactaaatctaatgcctattccacttgccagatctttgatatatagttagccctccaaagccacaggttccacatccttggattcagccatcacatatatatattttttattttattttattttttgagacacagtttcactctgcctcccaggctggagtgcagaggcgcaatctccgctcactgcaacctctgctacccgggttcaagtgattctcgtgcctgaacctcctaagtagctgggattacaggcgtgcgccaagtatatcgcaggacatgcagaggtacatcattttatatatgggaccttatcatcctcagattttcttatctgcaggaggtctgagaaccaatctcccatgaataccgagggacaactgtatttgaaaatagctgtccccacctctttattctctaaatgaaacatctctaattccttttttttttttttttttttttttttttttttttttgagacggagtctcgctctgtcgcccaggctggagagcagtggtacgatctcggctcactgcaagctccgcctcccaggttcacaccattctcctgcctcagcctcctgagcagctgggaccacaagcgcccatcaccacgcccggctaattttttgtattttcagtagagatggggtttcaccatgctagccaggatggtctcgatcttctgacctggtaatccgcccaccttagcctcccaaagtgctgagatcacaagcgtgagccaccgcgcccagcctctaattccttaaataatgtctcaaatcattttaattactccatcaccagacagactgttttctcctggaaagactctatccatgctccgaaaatgtgcctcttaaaactgaacactctcattttacagtagaggggaaaaaaaaacctcaacacaatactaaaggtctggaatattatgttcccctgtattttcatttatatttttaaattttttttggcgtgattgcgccaagctggattgcagtggtgcaatcatggcttactgcagcctctatctgctgggctcatgtaattctaccacctgagcctcccagagtagctaggactacaggcacaagccacagtgcacagctaatttttacatgttttgtagagacaggggtttcactttcttaggtttaaaaatatagaggcggtctgggcatttatgcttctgactacctgaataataccacctccccgttactgtctcaaagttaacaagagaaaccttttttttttttttttttaaatccccagacagagtctcactctgccacccaggctggagtgcggtggcacaatctcggctcactgcaacctctgcttcctgggttcaagcgattctcctgccttagcctcccgagtagctgggattataggcatgcaccaccatggccggctgatttctgtatttttagtagagatggggttttgccctgttggcaaggctggttttgaactcctggcctcaagcaatccacctgccttggcctcccaaagtgctgggattacaggcgtgagccactgcaactggcccagagaagcatttttttaaaaactattttaaataatatttaaggaccaggtgtgatggctcatacctgtaatcccagcactttgggaggctgaggtaggcagatcacttgagctcaggagttcaagactagcctggacaacatggtgaaaccccatctatacaaaaaatacaaaaattagccaggcatggtgccacacacctgtaatcccagctactcaggaggctgaggtgggaagatcatttgagcccaggaggcagaggctgcaatgagccaagatcgtgccactgcactccaacctgggtaacagagcaagattctgtctcaaaaaaaaaaaaaaaaaaaggaatatttaagtaataaacatccagctctactaattaaaaactaatgaaaattaactgaatccttggctgtgagtcaattcaacaaagcaccatgatctccttaaggcatttattttatttatttatattttagaggtaggatctcactatgttgtccaggttgtacttgaactccaaggctcaagtgattctcccgcctctgcttctcaagaagctgggactggccaggtgtggtggctcacgcctgtaatcccagcccttagggaggccaaggcgggcggatcacgaggagttccagaccagcccggccaacacggtgaaatcccatctctactaaaaatacaaaaaattagccaggtgtggtggcaggcgcctgtaatcccagctactcggaaggcagaggcaggagaatcgcttgaacccaggaagtggaggttgcagtgagccaagatcgcaccactgcactccagcctgggcaacagagcgtccgtctcaaagaagctgggactatgggtacagttcaccatgccaggctcctaagacattcatttaaatccacttagtcattcatacctatgcacaatatgtatagcatttacagtgtgtatcatgacacttttaataataaagtcagtgttttaaagtcagtgtgtattgtttcttctattttactttttaaaaaatcacctacagcacttaccacagtgtatgcacctagaaggtatataaatatccgtggtattaaattgaacacagtagaaagaatgctagagattaaagttcaaattctgactcagctacaacttagtaaatgaccttaggagaaggcagaattattctgggactcaaagtggttccagtaagtccatgagtttcatatttcacagccaatttgccatctatataacccaatgaaacttacagggaatgtaatttccattgaaaacatcaatgcttcaccaattccatatacacaaaaattattttctgatttgtatcactagacagtgtcttactagcattctgaaggtcacccatcccagtcacgaagcccttaattctcacaaccttgattttataaataaggaaacagatagactgatctgccccagacctcacagttattatgtggtacagatgaaacctgaaccttggtcttttgacactcagtccagtgctattactgccatactatagttgcctgtcactgataattgcaaagtttgttaatttgggcaagtctaccttagacttttagacaacacactgttgaaaggcaccccacctctggctgatgaaataggctgactggtttgcctctgaagcatctcagcaagtctcagctatactgagcacacaaagttattcagaatatctttcaaacatttttttgtccctattattgttatcttattttagcttgataaagaacaactgtctgggtagccactgacactcttaaaatatactcagcccaagagaacttgctaaaatggaacatactaaattggttgagtactaaagcaactggctatatcagagaacctcattatcggtgacccaaacttacctttaattatcagatatatgaccatgcaatactgatgttattgttttaagaaaatcagatgtgattaaaagtgtgagattatccctttttttaacctattaaactagcaatattagtgaaaaaaaattttttttctgagacagggtctcactccattacccaggctagaatgtagtggcacgatcatagctcactgtaacctcaaactcctgggctcaagtaagcctcctgccttagcctgctgagtagctgggactacagacaccaccatggctagataattttttttaactttttttttttcagagatggggtcttgctatgttggccaggatagtctcttttttctttttttttctccctcctcaggtgctacttaaccaggcttgttttgaactcctggcctcaagtgatcctcccacctcagcctcccaaagtgctgggattacaagtgtgagccaccatgcccaaccacggtttctttttatccttcttcttcttcacagagacctcttcttctaccactactacttttccttcttctccatcttcttcaattttaattttactcttggccttttttgctttctttgtggtaatttcatcttctttatctgttctgagttttttttaattttttactttttgtacaaatggggtctcactatgctgcttaggctggtcttgaactcctggcctcaagcaatcctcccatccttggtatccgaagtgctgggattccaggtgtaaaccactgtacctggccctattttgtgtttttgtagaacaggttggaagtgtggacccaccaatacattcttttaaaaaaatttttagtattttcttattaaaagggaactgtgggccaggtgtggtggctcacacctgtaatcccagcactttgggaggcagagacaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaagtacagtgtgcttttaaaaagcatttctccatgtctcgtaataaagggcagacaaaaatataacaaacaaatgggtcagatactgccctttaactgcaaatggtttgttacccccatgtctctgtaacttagtgaataagagggaaaggaaaataagtaagcttgagtttactcaagaagaaatctgagggccaggcacggtggctcacagctgtaatcccagaactctgggaggccaagatgggcagatcgctcgagctcaggagttcgagaccagcctgggcaacatagtgaaaccctgtctctacaaaaaaaataccaaaaaaaatcagccaggtgtggtggcacacgcctgcagtcccagatacccataaggctgaagttgggaggatcacctgaaaccagaaggtcaaggctgcaatgagccatgatgccaaaccacactccagagcctgggcaatggactgagacccatctcaagaaaaaaagaaaagagaaaaaatctgaacacagaattaacaatgaacatagccaatcattacgataaatacttctaaattcatgaaaaaagtagccgggtgcagtcgctcacacctgtaactccagcactttgggaggccaaggcaggtagatcactagaggtcaggagctcgagactggctgggctaatgtggtgaaaccccattagcagggtgtggtggtgcgtacctgtagtcccagatactcgggaggctaaagcaggagaattgcttgaacccaggaggcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggaagttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcagaggctgcagtgagccaagaaggcgccactgcactccagcctgggcaacagagtgagactctgtcccaaaaaaataaattataaattcatgaaaaaactatttttttaatgaggccagaacacatttccctagggaaataatatataaaatcaaattaatgttcctattcttaaatgcctaactttatgatccttagtattctgagttccagaaacaaaggataattaggggcaaaaggtatagaagagcagagacaaacgtgagaattgcctttcctggacctcaggaagcattttataataggtaaaaatagttttacaatatcccacttcccttctgtgccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacgagcctggccaacatggtgaaaccctgtctactaaaaatggtggcacatgcccgtaatcccacctactcaggaggctgaggcaggagaatcatttgaacctgggaagcagaggttacagtgagcagagattgtgccactgcactccagcctgggcaacagagaggctccatctcaaaaaataatcataattttaaaacaatatggaaatccaaaggaatacacacacacacacacacacacacacacacacacacacacacacacacacacaaattagcattagtaaacaagttcagccgggtgcggtggctcacacctgtaatcccagcacttagggaagctgaggcgggtgggatcacctgaggtcgggagtatgagatcagcctgaccaagatggagaaaccccgactctactaaaaatacaaaattagccaggcatggtggcacatgcctgtaatcacagctacttgggaggctgaggcaggagaatcgcttgaacccaggaggcggaggttgcggagagccgagatcgctccattgcactccagtttgggtgataaaagcaaaactccatttcaaaaaaaaaaaagaagaaaaaaaaagttcagcaaggccacagaataccagatctataaaaatcttttatttctctataccagcaatcaacaacacaaaatgaaataagaaaataattccattttcaatagcatcaaaaggaataaaatactaaggaataaatttaaagtaaaagacttgtacactaaaaactacaaaatagctggagaggatgtggagaaataggaactcttttacactgttggtgggactgtaaaactagttcaaccattgtggactacagtgtggcgattcctcaaggatctagaactagaaataccatttgacccagcgatcccattactgggcatatacccaaaagattataaatcatgtgtcttttaaagacacatgcacatgtatgtttactgcggcactattcacaatagcaaagacttggaaccaacccaaatgtccatcaatgatagactggactaagaaaatgtggcacatatacaccatggaacactatgcagccataaaaaaggatgagttcatgtcctttgtagggacatggatgaagctggaaaccatcattctgagcaaactatcacaaggacagaaaaccaaacaccgcatgttctcactcataggtgggaattgaacaatgagaacacctggacacagggtggggaacgtcacacactagggcctgtcatggggtggggggaggggggagggaaagcattaggagttatacctaatgtaaatgatgagttaatgggtgcagcacaccaacatggcacatgtatacatatgtaacaaacctgcacattgtgcccatgtaccctagaacttgtaagtataataataaaagaaaaaaaaactacaaaatacattatatatatatatacacacacttttttttttttttttttttttgagacagaggctcactctgttgcccatgctggattgcaatggcaggatcacagatcgacgtcctgggctgaagggatcctcccaccttatcctcaccctgatgagtagctaggattacaggggcaagccaccacatccagctaattgtgtgtgtgtgtgtgtgtgtgtgtgtgtgtgtgtgtgtgtgtgtgtgtgatatgtcggccagactggtctcgaactcctgggctcaagcaatcttctcacctcagcctcccaaagtgctgggattacaggtgtcagccaccaccacactcagcttaaaaaatattcttgaaagaaattaaagacataaacaaatggaaaggcatcccacgttcatgaagtggaagatctgacattgttaagatggcagcactctctaaattgatctacagatttaaggcattccctatcaaaattccaactgccttttctgcaaaagttgccaagttaatcctaaagctcaaatggaaatgccaaggatccagaatagccaaaacaatcttcaaaaaaacaaaattagaaaactcacacttcctaatttcaaaacatattacaaaagtacattaatcaagacagcatatttatgcagatagtagcagatagtagtaccacagggtgaaaatacaagaaagcaagcatgatggtactggcatagacgtacaccaatgcaatagaattgaaagtccaggccgggcacggtggctcacacctgtaatcccagaactttgggaggccgagtcaggcggatcacttgaggtcaggagttcaagacccgtctgaccaaaatggtgaaaccccgtctctaccaaaaatataaaaattagctgggtgtggtggtgcatgcctgtaatcccagctactcaagacgcagaggcaggagaattgcttgaacctggaaggcagagaggttacagtgagctgcgatcacgccactgcactccagcctgggcaacggagcaagactgtctcaaaaaaaaagaaagtccagaaataagcccacacctctgtggtcaattgactcaaaacatggatgctaagatgatacacaattcaatggaaaaagaagtcttttcaacaactggttcaaggacaactagatatccacacaccaaaaaaaacaaatgaaaaagattttgggccgggcgcagtggttcacgcctgtaatcccagcactttgggaggctaaagcaggtgaatcacccgaggtcaggagttcgagaccagcctggccaacatggtgaaaccccagtctctactaaaaatacaaaaattagctgggtgtggtagcgggcacctgtaatcccagctacttgggaggctgaggcaggagaatcgcttgaacccgggaggtggaggctgcagtgagccgagatcacgtcattgcacttcagcctgggcgacagagtgaaactccatctcaaaaaaaaaaaaaaaaaagaaacaaagaaaaagattttggattcctacctcacacatcatgtataaaaattaatttgaaattgataaaaaaaaaactaaatacaacagctaaaactataaaattatttaaagaaacataaattacacctataatcccagcattttgggaggcaaggaaagcggatcacttgagcccaggagttcgagatcagcctggacaacatagtaagaccacatctcagccgggcgcagtggctcacgcctgtaatcctagcactttgggagcccgaggtgggcagatcatgaggtcaggagatcaagaccattctggctaacatggtgaaacttcatctctactaaaaatacaaaaaaaaaaaattagccgggcatggtggtgggcacctgtagtcccagctacttgggaggctgaggcaggagaatggcatgaacccgggaggtggagcttacagtgagcagagatcgcaccactgcactccagcctgggtgacagaacgagactacatcttaaaaaaaaaaaaaaaaaggttaccaaaattagccaagcatcatggtgcacacctgtagtcctacctactcaggagactgaggtggaaggatagcttgagcctgagaggtggaggctgcagtgggcagatatcatgccactgcactccagcctggacaaaagacagagaccctgtctcggaaagaagaaagaacgaacgaacgaaagaacaaacgaatgaaaaaaacaaacaaaagagaaatctttatcaccttaaattaggcaatcgtttcttagatgtgacacctatagcacaagcaaccaagaaaaaactagataaactggacttcatcaaaatttaaaacttttgtgtttcaaaagatactatcagtcaggcatggtggctcacacctgtaatcccagcactttgggtggccaagcaagaggattgcttcagcccaggagttcactgggcaatataaggagaccccatctctaattaaaattgttttttttaattatccaggtgtggtggcacacacctacaatgccagctatccagaaggctgaggtggaagaatcacctgagccctggaggtcaaggctgcagtgaatcatgatcgcatcactgcactctagcctgagtgacagagcaagatcttgtctcaaaaaagaaaagaaagccaggcacggtggctcacgcctgtaatcccagcactttgggaggcggaggtgggcagatcacctgaggttgggagttcgagcccagcctcaccaacatggagaaaccccactctactaaaaatacaaaattagccgggcatggtggcacatgcctgtaatcccagctactcaggaggctgaggcaggagaatcgaatcacttgaacccgggaggcggaggttgccatgagctgagatcgtgccattgcactccagcctgggcaacaagaacgaaactcagtctcaaaaaaaaaaaaaagaaagaaagaaagagaagaaaaaaataattttctggttttaatttttttttttttatagagacagggtctcaccatattgcctgccccaggctggtcttgaattgctgggctcaagcagtccaccctcctcagcctcccaaaatgctaggattacaggcatgtgccaccacgcctggcgataaataattttttaaaaggttaaacataattaacacataaccaagcaattctccttctaggtatttagacaaaaataaatgtccatataaaagcatatcaatcttcacagagcattattcataatagctaaaaaatgcaacccaaatgttcatcaatggatgaatgcataaacaaaatgcattatatccatgtaatgtaatattattcagccataaaaatgaatgaaatgatacatgctacaacatggatgaacctaaaagcattatgctaaatgaaagaagccaaacacagaaaggccatttattgtatgattccattaatatggaatgtccagaacagacaggaagatgattagtggttgccagaggctgggtgaatgaagggaatggaagagactgctaacgggtatgaggtttcttttgggggtaatgaaaatgttctggacttagataatggtggtagttgcacaacattgtgaatacaccaaaaaccactgaattctatgattttgttttgttttgttttgacagggtcttgctctgtggcccaggctagagtgcacgatcatggctcactgcaatctcaaattctttggctcaagtgaatgatcctcccacctcagcctcccaagagtctgggactacaggtgtgcaccaccatgcctggctaattttttttttttttttttttttggtagagacagggttgccatgctatgttgcccatgctggtctcaaactcctgggctcaagcaatcctcccacctcagcctcccaaactgctgggattacaggcatgagctaccatgcctaccccaaattgtatgctttaaaatggtgagttttacgatatgtgaattatgtatcaacttttttaaatgtggaatgacatatgcccaaagatatacattggggaaaacatcaaagagtagggtagaaaggggccgtgaatgaccttctaaaggtgaaacttgagctgatatgtagagaactaagcctgtaaatctgccttatcccccactttctctgctcccaatccttcctaaactgagaaatcacttgtcacccaaagcaacacactcactacccaaattcaaattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacttgagcctaggagtttgagaccagcctgggcaacatggtgaaacgctgtctctacaaacaatacaaaaattggctgggcatggtggcacgtgcctataattccagctactcaagaggctgaggcaggaggatcacctgagcccagaagttcaaggctgaagtgagctgtgattatgccactaaactctggcaacagagcgagaccctgtctcaaaaaacacacaaaaatccgaaatctgaaatgctccaaaatctaatactttttgatgtcaaaggaaatgctcactagagagcattttggaatatctgtatactacagatattccaaaatccaaaaaatccaaaatatgaacaattctggtctcatatttcaaataatggatactcaacctatatctgattaagaatttcaaggctggagctgggtgcagtggctcacgtctgtaatcccagcactttggcaggccaaggtgggcgcatcacttgaggtcaggagttcaagaccagcctggtcaatatggcaaaaccccatctctactaaaaatacaaaaattagctggggcctggtggtgtgcacctgtactcccaactacttgggaggctgaggcaggaggatcgcctgaacccaggaggcagaggttgcagtgagccgagatcacaccactgcattccagcctgggtgacacagcaagactccatcttaaaaagaaaaaaaaagccgggtgcggtggctcacacctgtaatcccagcactttgggaggccaaggcgggcggatcaagaggtcaggagatcgagagcatcctggctaacaaagtgaaacaccgtctctactaataatacaaaaaattagctgggcacggtggcaggtacttgtagtcccagctactcgggaggctgaggcaggagcatggcgtgaacccgggaggcggagcttgcagtgagccgagatagtgccactacactccggcctgggcaaaagagtgagactccgtctcaaaaaaaaaaaaaaatctataaataaatttgttgtaactttgtcttctgacaataataaaaggcttagaaagcacatttcacgagaggtagctgggggaaaagccactagtgtggaaaagaaaaaggtgggacaaaataactgtcattgaataggtgcaaagttgagattagagctacagggaataactgtagacagaaaaattaggaccactgaagagaaactgcagggaggcagatctacaatcattatccggaaaatctttctaaaatgacaaatctgcaaacctggaattggtagcaaccagctgtgaagtacttatcttgggaaatacctgcatagagaactggaggaatcacctattatgtgaaacatttgtctagattatctctaaatctcttctatgattctacgaggaggaagaagtccagaaaaagaattgtttttgctctcaatactgctgaaagtattttttttaaaaaagctaaataccaggaacttctttaattaaaaggaacaatcccatcaagaagacaaaggttgatttgttagtcaagataatgagactgctttccttaggatcaagtatagcactgggagtgagaataggtcatttggccaggaacagtggctcacacctataatcccagaactttgggaggctgaggtaggaggattgcttgaggccaggaattcaagaccggcctgagcaacatagcaagactctgtctcttaaaaaataaataaataggccgggtgcagtggctcaagcctgtaatcccagcactttgggaggctgaggcaggcggatcacgaggtcaggagatcgagaccatcctggctaacatggggaaactctgtctctactaaaaaaatacaaaaaattagccagttggccgggcgccctggctcacgcctgtaatccgagcactttgggaggccaaggtgggcagatcacgaagtcaggagatagagaccatcctggctaacacggtgaaaccccgtctctactaaaaatacaaaaaattagccaggcgtggtggcgggctcctgtattcccagctactaaagaggctgaggcaggagaatggcgtgaacccgggaggcagagctttcagtgagccgagatcatgccactgcactccagcccaggcgacagagcgagactccatctcaaaaaacagaaaaaacattagccgggagtggtggcaggcgcctgtagtcccagctactcaggaggctgaggcaggagaatggtgtgaaccccggaggcgcagcttgcagtgagccgagattgcgccactgaactccagcctgggaaacagcgagactccatctcaaaaaaaataaataaataaaataaataaataaataaataaataataaatcttcaattctagatacaatcactcacttcctgtttggccaagggtaaatgatttcatctctctacctgagctgaaaaacagtaatttaaaataccaatattataggagtataatttaaattagttaacaactgcaaaatgctttggaaatttactttatatgacaattaagactattttttacttcatatatatattagagttgaaaaaattagcatgtattattcattaaatcagccaaatttctcactttcagagaaagaagcaaggaagagaatgctagaatgaactctgtggtgctggatcagcatcagagatatcagtataaactcatgtttatatttatatacagacagatacggaagtaaacgaagatatgtgtgggtcagtatatatatatattacttcctaactatcccctgagagggcctagaagcagtgataccctagcagtaatgagtgcatcaagctcatttagaaaccagatagtggtttccaaatactcttctccaacagaaggaaccaggacaccttggagaaatggctgattttagggttggggcaggtaaagtacaagatgagactggggcatcttacagtgccaggaagtacaaaagtgctaaaagacaaagaaaggtagggaaaggtatttcaaaagaacataggtgccaatgttagaatggccaaagctggaacaacttgagcaacaaaatacagtactggattataagcaaagaaaaaaatattcatgggtccatgttgacataaatgatttaataaataaatgggggaggcataaatcttccttacaaaaggattccaaatcataaaagtagaaagaattagaaaaatagaaaaccaacagaataatataatcaacgctgccgcaggcaagattcactaatgaatgctaaaataagtagaggaaatttttaaggagaaatcagattctgtataacctcacagttatcttccccaaaatattaactaattactttaggaattttaacatgcccacaaattctttgatactcctcccttcaggggttggagcttaattcccttcccccagaatatggatatgacttggtgactcatttctaggttctatcaagtaaaattaaaaagcagaacaacagtcactttacagtgcagaacatcactttaatcaagttatcaaagttaacaaggcacaatggctcatgcctgctatcctagcattttcggaggatgaggccggtggactgcatgaggccaggagttcaagaccagcctgggcaacatggcaaaaccctgcctttactaaaaatacaaaaattaggtgtggtggcacgtgcctgtggtcccagctacttgggaggctaaggcacaaaaatcacttgaattgggtaggcagaggttgccgtgagccaagatcatgctactgcactccagcctgggcaacagagcaagactttgtctcaaaaaaaaaaaaaaaaaaaaaagttaatcagtaacgagtcatgttgatatcaggtattcccagatatgatgtgacaagaagggtaaaccatctctatggtatttttccccaaaatgcataacctcgggctaatcatgagaaagcaccagaaaacccaaaatgagaaccattctacaaatgcatgaccactcatctttaaaggtgtcaaggaaagatagggaaggagagactaagaaactgtcacctattggaagaaactaaagaattgtgacatctaaatgcaatgtggtatcctggattggatcctgtaacaggaaaaggacatcagtggaaaacacaggaaaatcagaggaaagtctgtagtttgctcaataatattccactaatgctaatttcttaattttgataagggtatcaggttatataaaatgttaacgctaagagaaatggaatgaatacagaatgtatatagaaagtctgtactacctttacaactcttctgtaaacctgaaattatttaaaaggagttttaaactattttccatataaaaagaagtgaggaaagttataaataaaaaaatttattttttgagacagtctcgctgtagcccaggctggagtgcaatggtgcagtctcggctcactgcaacctctgcctcccgggttcaagtgattctcctgcctcagcttcccgagtagctgggattacaggcgcccgccaccaggcccagctaatttttgtatttttagtagagacggggtttttaccatgttggccaggctggtctcgaactcctgacctcttgatctgcccacctcagcctcccaaagtgctgggattacaggcatgagccaccgcacccagcataaataaatttttaaacatatttaaatatatgcaaactaataaaatattagtttacagtaagattaactttttttttttgagatggagttccactcttgttgcccaggctggagtgcagtggcgtgatcttggctccctgcaacctgtgcctcccagattcaagtgattctcctgtctcagcctcgcgagtagctgggattacaggcgcttgccaccatgccagctaatttttgtattttagtagagacagggtttcaccatgttggccaggctggtctcgaactcctgacctcaagtgatccccctgcctcggcctcccaaagtgctgggattacaggcatgagccatcatgcccaagccaagaagattaacttttttaacctataaataatcacaatagctggtcgcagcgggagtgcctgtaatcccagctactcaggaggctgaggcaggagaattgcttgaacccgggaggtggaggttgtggtgagctgagatcgcgccactgtactccagcctgggaatacagcgagactcagtctcaaaaaaaaaaaaaaaagaataagaacaagaatcacaaaagttagccaggtgtgatggtgcacatacacagtctgaactactggggaggctgaggcaggaggatcacttgaggccagaagttcaaggctgcagtgagctatgatctcccccactgctgacagaacatgatctcatctctaaaaaaaaaaaaaaaaaaggaaaaagaatcacgaaagtaattgtgttgactttcaaccttaaaatgttaatgacatccaaaatagttcaccataaggtctgcatttaaagactggcctaggagctctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttgttttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggtcaaaatgttcctctcagattttctcacatcttaaggaaatctaaaagctacatagcaactactcacgcttaatctttaaaaaaaaaaaaaaaaaaaagcaaagtgattccaaaaactgtcaagagcaaaagtttacagagccaaaggattgatcaccaaattcagaaacaagattaggaaagaacaagacactatgagattaggaagaacaagacactatgagattaggaagaatctactctctgactaaagctaagccgcctatatataagaaaatccaggtgcttccttcactgtcagcaaacaatggaaaatgactttttaataggtaatataaatgtatttgtaaatttgaaaattttaacaaagggatgctggaatgacaaatatttgaagagactacttaaaaaacaagtgagacagagtaggaaaatgtgttaagacatcctccagcactgtatgtgtttttacactggggaaagggagactcactagacttttgttccttgattaaaatacccgtaaggccaggcgtgatggctcatgcctgtaatcccaacactctgggaggccgaggtaggtggatcatctgaggtcaggagttcaagaccagcctggccaacatggtgaaaccccatctttactaaaaattcaaaaattagccaggcgcggtggctcacgcctgtaatcccaggactttgggaggccgaggcaggcggaacacgaggtcaggagatagagaccaccctaacacagtgaaaccctgtctctactaaaaatacaaaaaattagccaggcgtggtggcacgtgcctgtagttccagccactagggaggctgaggcaggagaatcacttgaacccaggaggcgaaggttgcagtgagctgagatcgtgccactgcactccagcctgggcaacagagtaagactccatctcaaaaaaatatatatatatgtgtgtgtatatgtatgtatgtgtgtatatatatgtatatgtgtatgtatatatgtatgtgtgtgcacgtatatacacacactcacacacacacacacacacaaattagccaggtgtggtggtgggtgcctataatcccagctatcaggaagctgaggcaggagaatcacttgaacctgggaggcagaggttgcagtgagccaagatcatgccactgcactccagcctggatgacacagcgagactccatcttaaaaaataaaatagaataaaataaaaataaatggccgggcatggtggcttgcacctgtaatcccagggcactttgggaggccaaagcaggcggatcacttgaggtcaggagtttgagaccagtctgtccaacgtggcgaaaccccgtctctactaaaaatacaaaaatcagccgagtgtggtggcacatgcctataatcccagctactccggaggctgtggcaggagaactgcttgaactccggaggtagagtctgcagtgagccgagatcctgccactgtccagcctgggcgacagagcaagaccctgtctcaaaaataaataaataaataaaatttaaatttaaaaaatacccactaagaatatctagtgcctttccaattccataatcaactacctttttattactgattaggcagcccagaacaatggaggtgtcctggtcagtggacaattaaatccaattgtgcacatggcacttaatacttccaacatgcattaactggtatctggtttatcagtctctggtgagtttgtttactttgcatgaataaattctcaagcacttgaatcatcccaatgtaaaccaaaattctgaagtttctgaactactatgtgggggttggagagaccttggtttggttggataccatttttgccacttaactatctgtgtgacctcttcttcccatcagtctcaatttcctcatctgttaacaaacatagctagtgcctgggagatggcaagtgctcaaaaagtgacagctttattattttgaagctaaatttgaaaggaagtgtgtaactgaggtgaaaacatttcatttgaaaagtagtagtacggatcagcaaactacgttaatttaaaagacacagcctgaagagagatgtcccaatctttggagttgagaaaagcaaagtttaaaagttgcaagtaaagtacacactgcacagtacagatgggagtctcctgcttagcaactttaatgttgtctaccaaacacccagcttgtaatagagcatgacaactgttcactctaaatccatgtgctcagcttggattcaggattgatttataaaaatagctgctggtggtgctctttgaatctctttgggctgatgactgggcagtgttaccccaaaggcctagagcagctgtattccctcaccacacccatttctctgtctacccagccaagctgacggcaccctgcccccgccccccatctctacagcatactattcaccctcctcctgggctgagtgagcaaattacaagcacaaatatcccctgatgcaatgccacaaccatccctgggaaagagcagaggcagttgccaaaagcacagcagcagggaaatgggcgggagacgcgcgcgcgcgcacacacacatacacacgcacgcgcacacacacgcacgcgcacacacacacacacacacacacacacacacactgcaagaaacactgcaatgctatgcaaccagggagagagaatcgagaggccctggggagcaatactgtaacaggaccagagaaggcaaaggagaaaagggggtttccagtagaaagctgggtaacactaaccttcgcgaggaacacgtatttcatccgagcttgggtcctaaagcacaaacctaaaggtaatcaatcactgcctcttccccaaagcagcaaatgcatttaatttacccgttcctggaagtgagcaaaaccctcacaactcctccacaggacaatttcaccaaagggatctaactcacaccggcggagaacttgttccatgtgctaaatcacaatctctgttctgggtaatgtttccaactgcctctcctagtccctgtaccctccccacccccaccctaatgtgaccctttcgcactcccactgccagacacacgctttagtccccacacagtgtcggggcctttgcaagggggaagagccccgcctagggcccggttctccagaccacccctcagccccacccataatccctgactggacatactaaggctcacctcagcctcacatcaactgacccccacaaagcctcagaaaacgacccctgagttctcctacacctccgaaccccacccagggccccagactgcggccgaccctcgctccgcggctcagccccatccagagcccaaggcatgtcgctcggccccaccgccccgaccctcaaaagctggacctctcagcccccctcactccaaagacccccctagatcgcgcctcaaagactccgaaggtcaaagccgccagccccccgcctggccccctccctcggacgcccccgcgtctcgcaggccggcggccaccgcccttccacgcctcgggcgggccccgtggggtacccagctgccgcagggcaaggctcgggcagccccgggacagtgaggaggccgcccctccaatcggaccccgcctgcggctgcacctacccgccgccgccgagacggagctggggcagaagggagccaggagagcgccgggaagagccgtgaggaggtaggagacgtcgggaggagccgggagccagcgagctagccggaggggcggggcgcagggaggcggccgcttcctcgtcgcctcttgagggccggcgcaagggagggacgccgccaccgcctacccggcgagcgccgccgctccggccaataagcgtggcgagggggagggcggagggctgtggcggaccaatgggtgctggccctgccgccacgacgtctctgcagagctgcccgagccgcgggcggttggggcgaggtgcgcctgggggctctagcctcccgcctgcggcctgcgaatgccgaagcggaccgcaggccgatcgactgccttcgctgttctatgatggccgtcgctctctctcagagtctgggcgcccggagcgaggagagtgcgagagtcggcgcacacgcggaccgggccaccagcgggtggggcct

SEQ ID NO: 412 - DNA, 238590 bp, Homo sapiens; identical to SEQ ID NO: 411

SEQ ID NO: 413 - DNA, 116201 bp, Homo sapiens
taaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaaaaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatatttgaaaaaaacaaatttcaaacaaaaataagcataaccaaatggaaataaaagaataaataaatgtcaatcatgaagtgtgagtgtacacaacggaaagtcatacccaggcttctccacccataacttagacagctacagggactggttacgagcaatagaaagatgtcaaacatgatttttaaaaataactactaccagttttgaaaagatccctggcgaaagaaaccccaaaatcaacttaataaataactgtacaccaaagggaaagggttgtgttttctttgatggtgtattctctatggcaagagagttttaatattttatcaactgctaagaagataagcataacctctttcctttaaaacatatcaccctcaagtgtcttctgtccagaatccatagaagaaatttttgtcagagaatccagcccttgtgaccagacccctgtagaagagggaatgcttcctaaattccggaagtcgctgcaaggattcagtttaaactttcatgatattctaatcttaccatctcaaaagtagttctgtatcaggggatctaaaacaatgtatatctggccaggcacagtgtctcacacctgtaatcccagcactttgggtggccaaggcgggtggatcacttgagatcaggagttcgagaccagcctggccaacaaagtaaaaccccgtctctactaaaaatacaaaaattagctggtgtggtggcgcacacctataatcccagctacttgggaggctgaggcaggagaaccacttgaacctgggaggcagagggtgcagtaagccaagatcgcgccaccgcactccagcctaggcaagagtgagaccctgtctcaaaaacaaaaaacaatgtatatctcaaaatctttctcagaacatggtgccaattatttcttttaagctgaaataatctgtaccttgggggttataagaagctgcataatcagtaaaaggatagaaaactttaaagtatttcagattttaaaccagaattcctctaagatttcaaaacatggtccatgttttatgttatatttctataaatacaatcaaagcataccattgtacagtactaatctcaactggttctagatttaagcaattagtttgaaaaaattaggaatgggaataagaaagtcctgttgaaacaatcttagattgttaagagtccgtctccaaaaaaaaaaaaatttggcccaacttgcaaataataaaggattatttaatttggaaaaatattctaggattactcagaactactcaatttaaaaacttaaaatatctatcattatttagattttagtaaggtggagagaaacataggtagcctgtaagattaaccttccctaaaagcaagctcagagaaggaaggaggagggagaagaaaaggaaattcgctgcagtactggtggcctcaacccctttatgaaaacacatgttctcatttggtgttacactattctgattcatgttgaacatttgaaaaccaaaggaaaaaggtcaactaaaaatatttaaaggaaaaaaatgtgagaatgaatcaaatgataaaatcataaagaaaacaagaaataaaagacattagataacctttgtaaaaattactaaaattaaaaagaattcattttgcactttgtgttcacaaagggaaatgaggctccatcaaaccctgcagagcacaagaggaagcaggttgtttgctcaggcatcagcagaaataggccccgaagaactaccctcagtttcttctacatcatgtccaggaatgaaaagcaaagctctgcaaaatgctgaaggttttagaagtataacgatgcttaggaaagatcactggtctggtgttgcagcagccccagtgttgagagacacgctaggcttctaggaggagaaaaatagagagggaggaagaagtaggaaggggaagaaaagggtggaaaagcacaggtcattagtaaacagcaagttcaatatcacaagatgctcataaaccaaagctattaatgaagctggtttgctctcgggactatagataacattctgaaggaaacagaaatgggaattttcaaaatggcattgagttagatgctccaggtagtgatggccaaattagaatgaagtcaccacatgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaaatggcatccactctttcaactgcctaatcaagtcaatcccctccagcctttccttaccctggttaactggttcctgcttaaagaaagctgaatttactcattttttaaaagttcatgttcaaacttctcctttaatcacagggatatttgcataaatgttttcttaaaaaccacatcacatagatgactgctttcaaagcagacacagaaagtcaatactacatttgactgagattatcaaagaaatacaaaaacatcaattcacaaaactggaagataaagtggcatttctggttgtttctagcttctaaagtaaagagttcctaatttattaagttgctaataaggatgtatatgtcacttggtaaacattcacaacaaaaagaacttggtcatcaaaaaatctgatgtataaagatatatacaactttcctatggtcatagaataaagaataaatcctagaatagctgctattgctaacagaaggctttctggaagccttagaaaaagagaaatactgtggtgcctcacagaagggcttctcatagctgaggtatgcatataagagaaatacagaaatatgacaaatctagtaactacctccactgcaataatatgaatcaaatgtatggcccagttaagagcacacttgcaggaaacaatgggattgatcattagaagtcaactcatttgggttagcagtgttggcctgatcacaactgcaaagtaaatgcaggtatttatgaaaataaaacacgcaactctcacatcagctacttaagaaaatatttatatagtatatccctgggactcctgctactgctttgagaattttgctcactacaaagacattggggcagggggttggtgctggttatgagacaggaacccacagaaactcaatgctaactgaaagaatatcaaaaccctagtaaagagctaagagtttaattagaagtaaatttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagaacactaccaccctcagaaataattcatatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaatttaaacatttaacaaaaggaaacccagaaacagaactgaacagaatcattaattcctagggcacccaagctctgtaaagtaccagttccataggagagcccctcataatagcaagtctaaatctttttcattctgtaaattatcaaagattaccattaaattcagtaaaaccatcatggagcaacacaggtttggtatcagcaattcaaatccaaatcaaacgctccaagaacacgagggcatttgttttattattattattatttttgagatggggttttgctcttgtcacccagactggagtgccatggtgcaacctcggctcactgcaacctccgccttctgggttcgagtgattctcctgcctcagcctcccgagtagttgggattgcaggcacccgcccccatgaccagctaatttttgtatttttagtagaaatgggatttcaccatgttggccaggcgggctcaaactcctgacctcaggtgattcaccgccttggcctcccaaagtgctgagattacagatgtgagccaccatgcccagcggaggccatttattaattacttattaattcccacacaggaaatccagggtaccatcattgcttctggatgaagattgcatggaggtaaccagctgtatttctggaagcagaggactcctttttttttttccctcttttttttttttttaaggaaattagttgtatcttattccctaatgactaaggatgttgagcatcttttcatgtgtttctctgccatccctttgtcttctttggtgacttgaatggtcaaattttttgactattttaaaactgaactgtttattttcttattattgagttttgaaaattctttatgtattccaaatatcactcctttatcagataaattttgtaaaaatttcttccctgtttctaacttatactgtattttcatttacttaactgtgcctttcaaatagtttttaatttttatgaagtaggtcacaggatttttttccccatgttttcttctagaagtcttatagttttcatatttacatttcatattgaggcctacggtacattttgagttaaattttgtatatggtgtaatgatgtgggtctaagtttctattcctgtacattcctaagtttctattcctgtacctaataattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctcccaaagtgttggtattacaggtgtgagtcactgcgcctggccttgttttgtttctttgcttttccatataaattttagaatcagtttttgatttatactaaaattcttgatgggatcttatatgcaattgcatataagactatatagatcaatttggggattgactatatagatcaatttggggatgtacaactttttctgaaagtctctgactatatctaacattttagcaaccagcctagctctgcagtcaccttgctgaccgaagaattcagagatattattcctaagacaataagtgaatatctacaatatatgctactaaaataaaaaatgcaagattttactttggaagaccacaaacatgctgtccaaccccttagtcctcataaatacaaggcagaaatctttcacacaagcttcttgttgaaaagatcattcattctgttacttaagaggaacagccaaagagaacaatctaaaagaacaaggcagtccaaaaccagaatataatttaaataaaagaaagaaataaggaaggaaagacaacagaattctattaaatagccgctatgtaacatataccctgctaagtcttcacaaactgcattttacttatccagagagatgccataaatatgctccatcccacatttggcataagtaaattccctttcacattcacacaataagcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatcacaactactctagaggctgaagcacaagaatagcttgaacctgggaggcagaggttgcagtgagctgagatcgtgccactgcactccagtctgggcgacagagcaagactccatctcccaaaaaaaaaaaaaagctttattcccatatatttacctatgtgattagggtttcttcactatgatagctacaaaaacaggaaaaattgccaatcctatttcatcagagaaagaaatattgatccacagacccatgatttaattgagaaaaataacagaccccatcatctcataagaaaagcatttccaataaaattcaacttgtatagtaataacatcaaaaattacaacctatgttggccgggcacagtggctcatgcctgtaatcccagcaatttgggaagccaaggtgagcagatcacttgaggccaggaattcgagaccagcctggtcaacacagtaaagcccatctctactcttcttgaggaaacaaataggattaagtgaaaatgaagggagatttaaaaaaaacataatacatgcaatagactgataaatttcctctggaccaagttaaaacacagaacctttgtcacaggaactttaaaaattaaaatttaagtttacatacatatttagtagcagaaacatattagcacaatcaagaaaaaacttttaagcataaaaatatattacattaggataaaagtctgagacatgttatggaaataaaagttcaaggactcaaaagaagaatttaaatttccaatgataaagaacagcttgttcgtatatttttaaactagatgatggaaaccaaaatgctatatatttagaagcatttggatacatttagcagaatgaggtaacttatttttatgtggcaaaagtaaaacattctcaaaattacatgttttacaactaaacttttgctacaaaattttagatgtaaacttaatgtacaaagagacagaatttatcagaattctgagtatgtgaccaaaagttaagaccactactttagaccaagttaaaaagaaagcttgatatatactgacagaaagttttctaagataataaactaaaaaaagcaagttaaaattcatacgatttgattccatttgtaaaatggaatcaaatgaaagtaaagccactaaattttttattgtatgtttgtaactgcaaagaataaagtcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcaagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagtgcagtggcacaatctcagctcactgcaacctctgcctcccaggttcaagcgattctcatgcctcagcctcctgagtagctggggctacaggcatgtgccaccatgcccggctaattttttgtatttttagtagaaacaggatttcaccgtgttggccaggctggtctctaactcctgacctcaggtgatccacctgcttcggcctcccaaagtgctgggattacaggagtgagccaccacgcccagacaattctatttgtataaagacagggtctcactaagttgctcaggctggtctcaaactcctgggctcaagtggtactcctgcctcagtctcccaagtagctgggactacaggcgtgagccaccatgatcagcctcgtccactgagctttaattcaatgctactttatttattttgttgctcaaatttttccagtgttggctattgggaactctttcagttgactcctgtgtccctctgacacactatctctgtcattgtgggctttggagcataactccaacagtctttttataaatgatctgtgcaattaaaggtaatttttttttccagtgaagggcataaataatgagatttaattgcgaataatatgcataatggaagtctcatttgcacatatctgtttactttctccctgcctttcctcctgcctcagcctcctgagtagttaagactaccaccacacccagttaattttttattttttttttctttgtagagatgcagtcttgctgtgttgctggggctggtatcaaactcctggcttcaagtactcttcccgcctctgcctcccaaagagctaggattacaagtgtgagtcaccatgcccggcctccctggtatttttgacctaaaatgtgcaaaagggaatttctgattcataaaatgtgactttcatataagatgcagcagaacacatttcaactggcttggaaaccagaaaattattcaaaagctatttgcttagatactaaaatagtaggtgaaagttggattagatacaggatacatacatagcctcaaaatatctcctcacaaattacttattcattacaaggagaaaaatataaattttacagtaaagaggctgggcgtggtggctcatgcctgtaatcctagcactttgggagggtggggagagcagatggcttgagcccaggagttcaagaccagcctgggtaacatcacaaaaccctgtctctattaaaaaaaaaaaaatacacaaattaaccaggtggccaggggtggtggctcagcactttgggagaccgaggcaggcagatcacatgaggtcaggagttcgagactagcctggccaatatggtgaaaacctgtctctaataaagatacaaaaattagccaggtgtggtggcacgcacctgtaatcccagctactcaggaggctgaggcaggagaatcacttgaacccagaaggcggaggttgcagtgagccgagatcatgccactgccctccagactgggagacaaagtgagaccccgtcttaaaaaaaattaaaaaataaaaataaaaattaggctggggggtggctcatgcctgtaatcccagcactttgggaggcagaggtgggtgaatcacctgaggtcaggagtttgagaccagcctggccaacgtggtgaaaccccatctctaccaaaaatacaaaaattagccaggcatggtggtgcatgcctgtaatcccagctactcgggaggctgaggcaggaggatcacctgaacctgggaggcggaggttgcagtgagccaagatggtgccactgcactccagtctgggcaacagagcaagactttgtcaaaaaaaaaaattaaccaggcatggtggtgcatgcctgcagtcccagctacttgggaggctgaggctggaagactgcttgagcctggggaggtcaaggctgcagggagccaagattgtgccactgcactccagctagggtgacagagtaaggccctgtctctaaataaataaatgcttttttttaattggaaaaaaattacagtaaagaaaacaggcagacactaacaagtgatgaaagttattatcaccaataatgtgatttagtgacatcatgtgcttcctgatgtggtgcacttaggacacatcatatttacatagtactactgccaaaaatgtggaacttgaatctaattatgaggaaatgccaggcaaacccaaattaggggacttctaaaaaataacttgcccatactattcaaaatattaaggtcatgaaagacaaagaagagttgaggaactgttccaattaaagaagactgaagagacatgaaaactaacgtgattccagatttaattgcagacaagaagaaaaaaatgagaaaggaatgtgttgaatctgttgggacaactgatgacaatgaaataaggttcgtggattagacaggaatatctcatcagcatttaacttctgatctctatcatcgtattcttgtaatgtgctaatgcctagttcttcggggaaagaggtgtgagttctgcagtttgttctcaaataatccaaggggaaggaactatatgtaaatataacaagaatgataaagcaaatgtgcaaaacagtaatgataaatccaagtaaagggtacatggtaggttcttggctctgttcttgcagtgtgaagtttaacaaagtcatttgcttgcagaatattatttaagaggtggggtctttggggtcttgctatgttacccaggctggactcaaactcctaggcttaagcaatcctccttcctattaagtagctcgggcagggctacaggtacataccaccatcctggcttgcttgcagaatatttttagcaatgaagtggtttttttgttgctttgttttttgttttttggggggtttttttgtattttttttgagatggagtcactctgtcgcccaggctggagtgcagtggcacaatctcagctcactgcaacctccacctcctgggttcaagcaattctcgtttctcagcctcctgagcagccgggattacaggcgcatgccaccacacctggctaatttttgtatttttagtagaggcggggttttgccatgttggccaggctggtctcaaactcctgacctcaggtgatccatctgcctcggcctcccaagtgctgagattacaggcttgagcccccgggtcccggtcccctgctcttctttcagactagggtactattattatgaactatacattttggtacgatattttttttccccaaaaagaactattagttatgagataaaagtctgttttcaaatcaaagtcagaaaataactatttttgcaaaaatgtcacactaattttttatgcatatatataaacttccctaaatatgatcatgagactattaagagggtttaggattagaccaagtacacctaccctaaataaatatctaccattttggagacacaattgtttgttagtctgtacattaacacaacccaaacctgaataaactgacaaacaaaaaccatttcaattcagtgtaataagcaatgattacacatctatcatgtgccaagagcagtggtctctaatgcagatctggccaggtttctcagtacccctgcgccctcagtttctcacaaaccatgagattcttcataatttcacttgatctgcttctccatgattctctccggtcacttgtcactgtaacctttgatttcttaaccctgagaaacttgaggtcgctagtaaactttgattatgctgtgccatcctgctttcgctaaatgtgtcattctccatgaaatatggcagtaaacaaaatattattcctgtgctagagcatgttaataagtgtaagataacaaatagcttaattatgatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactaaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggctcacgcctgtaatcccagcactttgggaggctacggtgggcggatcacgaggtcaggagattgagaccatcctggctaacacggtgaaaccccgtctctactaaaaatacaaaaaattagccgggcgtggcggcacacgcctgtagtcccagctactcaggaggctgaggcaggagaatggcgtgaacccgggaggcggagcttgcagtgagccaagatcgcgccactgcactccagcctgggtgacatagcaagactccgtctcaaaaaaaaaaaaaaagaaagcaaagcaaaaagatagatgagatggatgtgagattcagacaggattttttttttaatgataaaaaaattatagtatgtttgatgctggtgaatgacccaattgaaagaaaagaactgatgatgcaggagacagaagaggtaactgtgacagcagtggcctgagtgacagcatgaacagttcacccataacagaaaaagagcagacaataagggcatagatgaacataggtgaggaggaaatatgtggtgggaccatgtggaagttctgttctgattaagccaattaatttatgaatatgacttatgaatatgaacaggagagcaagtgccagaagtttcagagagtagatgtgaaacagttgtctaggaaagtgaaatattttacaaactcatgtgaattagtggcagagtccctcagtttgtgctctgtattgaaatgaagcaagattcttttacatttcctgaacatacatctaataattctatttgaatttaaaaaatggatttttagtttttaaaaactatcagtgagatactagatcaagtagaaagtatgtgttcatgaaaaaggtatagtttcacagaaagaacaggggtttattttatttatttattttttgagacggagtctcgctgtcgcccaggcttgaatgcagtggcacgatcttggctcactgcaacctccaccttctgggttcaagactctcttgccccagccccctgagtagctgggattactggtgagcaccaccacgcctggctaattttttgtatttttagtagagatgagatttcaccatgttgatcaggctggtctcgaactcctgacttcgtgatctgcctgcttcagcctctcaaagtgctggggattacaggcatgagccaccatgcccagccagaacaggggtttaaaatgagaagatccagtagctcatgtctgtaatcccagcactttgggaggcctaggcggaagggctgcttgaggccaggagtttgagaccaacctgggcaatatagcaagaccacatctctatttaaaaaatattgttttaattgtttaataaaaataaaagtgagattagaagatctgggttcaggttgtgctgtcattattaactaaatgatcaaatgcaaccttctcatttctaatacttaagcttcacctgggaagtgggactaaatgcagtaatacaggatgtcaactgtacagtgctaaatagtaattgttattctcactgttattagctattgttattctcactgttattaactatatgttgaccaactgtaaatttatctatcaaccacctatagaataactgtaggctgatcaagaaactttactagaataaaataaaatgaaagcaagaagaggttagaaaggaagaagagaagctggattctactatacatacaacacctcacaatctaaaaatataagcccaggagagaataaaaacaacgtaacaacactaaaaacaataaggttgacaagtagaaaaaaggcttgtatatttccctgccagataagacatactggaccctaatcatactgcacattactggaaaagtcctaattcaaaagatgctataatgtgttttctcactgactgacttccccagagaacccccatttcatgaaatgaaaactttctcagtgaaatacacacagcatcgaaaatagcacactttttttttttagaaactaatcacattctctgagatataaagatattcaaatttactttattttgttgattccctctccccaggagatgtcagattcccacagcaggcaaatcagcttggcagagaagtagcaagaacctgagaaggcatgtgtgctgtgagtcagccttgggcaaaacagccaggtctcaatgcaagggaaccctctggtgctgtcagacccatgccaacactgccctctactggccaattaagctggttgcaattttctgcaaaagaaataccagtgtattaaggagaaattctgcagtatctattaatagttgtcacttaggcccttttccatggattagtgtttctcaatcatgcatgtgtatccgagtcacctattatggcttgttaaaacagactgctggtgtgtggcagggtacggtgtctcccacctgtaatcccagcactatgggaagtcaaggcaggaggatcacttgagcccagcagttcaaaaccagtccagtccaggcaacacagtgagaccttgtctttactaaaaatgcaaaaaacttagccaggccattgccctgtgttaacttcttattctatgggaataagcttttagcttcaaaggccttatggaatgttgaggagaaagcattttctcgacttcagaagaagaactatttaatcacacagagaacagaaaaattaagtgacttgttccataaatgtgctatttgtgtctgagggtcaatactgtgctagatgatcatctgaaagaacaagagtcacagatgtttgcttcgtcattcacatctaagagaaagggttctatcttttgtctccctcacctagaaaatagggccatataatgctgataatgaacaattaaggaaaacaccattttttaaggaaaaaagtcaggaagtacataattttctttttatttttttcttattacagccgtggtgcaaaacaagtagtacacatatcctgaaaaagtatttgagaattgtttcccaaggtgataggcattttagaagaagagtttgacaccaattttatttctaggtattggtatttagatggtttacacaggcaatgctaagataaaatacttgtagaagcaagaataagttgaagtgcaaaaggaaatgagtatagtagatccaaagaaaaggaataaaggtcggggggttcttgtgttgccaggcatgaaggcagaaatcatacttagagaaaaaagcaattttcctactttgtcataaatgccataaaagcaaccctgctttcttacttctcattttataagttgaagacaattagggtggacatgtaagaattaaaggaaataaaacaccattgttcaaagagttctattatgtgtaacctactcaaccgtcccttctatatctagaggcaagaaaatggttgataaacttccactggttggcctaactaagcctgttgtaagaacatatcgagagcactaggctgggtgtggtggctcacacctgtaatcccagtgctttgggaggctaaggcaggaggatcgcttgaggccatgagttccagaccagccagaggaacacagtctgactgtcgctataaaaataaaaggataagcaaggcacgcgcacctgtagtccaagctattcaggagcctgaggcaggaggaacgtttgagcccaggagttacgttagatgttgcagtaagctatgattgtgccactgcactccagcctaggtgacatggaaagaatctgtcttttcttttttttttttgagacggaatttcgctcttgttgcccaggctggagtgcaacaatggcacgatctcggctcacggcaacctctgcctcccgggttcaagtgattactcttgcctcagcctcctgagtagctgggattacaggtgcccaccaccacgcccagctaatttttttgtgtttttagtagagacagggtttcaccatgttagccaggctggtctcgaactcctgacctcaggtgatccacccgcctcagcctcccaaagtgctgggattataggcgtgaaccaccgcgcccagtaagaccctgtcttcaaaaaaaaaaaaagtgtcagcaatcagcagtagtttactgaacctcatctaagaacaaaatcaaacttaaagttagatgtataataaaacattaatgaagtctagggcccttccatcacttctaaagatgtattcagaagaacatcttgtttagaatgttctccaggaaaaacacaaatatgaaacctgtcattatggcaaaaaccatcagtccgataatgtataaaaatcagacccacagcagagaagtctccattcataaagaactcactaattgcaccagatttctacaagactaaataaggcggcttccttcgtttttcttatttgatgtctccaaacagccatcaccccttcctttaagttaagacttctacaacttttaggaagctggtatggaaaaaatgtagtaatttacaacctatcataattataaactttattattattattatttttagagacggggtctctctctgtcacccaggctgcagcacagtggtgcttttatggctcactgcagcctcgacctctggggctcaagtgattgcctcctacctcagcttcctgtgtagctcggactacaggcgcacactaccacgcccagctataattataaactttaaacatggtatcttcaacaagttcgtggaaaatgcattctatgaaaaaattattcatggatttcaagggagtttttttgtatcaaaataactcatactccagcctgaccaatatggcgaaaccccatctctactaaaaatacaaaaattagctgggcatggtagcatgtgcctataagcccagctactcaggaggctgaggcaggagaatctcttgaacacaggaggtagaggttgcagtgagccgagactgtgccaccgcactccagcctgggtgacagagagacactccatcttaaaaaaaaaaaaaaaaagctcatactaacttgttataacacgtctgaacaggatctagtttgaagcactaaaaaggataaaacatcagtttgaaaagagcccctaataaagcaacatgaattctgctaaaattgaagcaaaagcaaatggtaaatttatggtgaagcttggatgaaagaatggtgaaatcactgatgctttgtgtaaagtttatggggacaatgccccaaacaaatcagtagtttacacatgaataacttgttttaagacatcagccagatgcagtggtccgcacctatagtcccagctacttggaaggctgagacaggaggatcacttgagcccaggagttcaaggctgtagtgtgctatggttacacctgtaaatagtcactatactctaatttgggcaatgtagtaagactctgtctcaaaaaaagaaaaaaaataaaggaggagatgatgttgaagatgaagcccaccgtggcagaccaccaatatcaatttgagaggaaaaaagaatgatctaattgaagaggattgacaattagcagaaacaatagccaataccacagacatctcaattggttcagtttatacaattttggctgataaattaaaattgagcaaactttccactcaactggtgccaaaatggttgcatccagatgagctgcaaagagcagagctttcgatgtaaattttaaacaagtgggatcaagatcctgaagcatttctttgaagaattgtaacaggagatgaaatatggttttaccagtataatcctaaagacaaagcacaatcaaagcaatggctaccaagaggcgtaagtgctgtagtcaaagcaaaagtggatcagtcaagagcaaacacaagagttttttaggatgctcaaagcactttgtctgttgactttctggagagccaaagaatgacaacatcttattatgagggtgttttgagaaagtcagccaatgctttagcagaaaaacagccaggaaagcttcatcagagagtccttctccaccaggacaatgctcctgttcattcctttcatcaacaaagataatttgtgacagttttgatgagaaatcattaggcaaccaccttacaacagtcctgatttggttccttcttttttgtttcctaatctttaaaaaaatctttggtagcaacaaaaaattaaaaacttaaaccaaaaaaaactttaaagggcatccatttttcttcatttcttcatttttcttcatttaataatgtaaaaaagccaggcacagtggctcacacctataatcccagcacaaaagaaaaacaaatatttactccaaaaaatttggattccttaatggaaaacgggaaaatctattctctcttaatccataatgcacggtggagacatttgttctttgactgactaacataaacaaagaaaacctagtatgaagaaaggaatgataagatgtaaatatggtagcaactagtcatggttgagatgctcttcccatcctaatattaacttaccctcatcagtcataggtgaaagaagctagctgcttttcgttttctaatttcctttaactgtgcattgtttccatcatctgggaatgagcctaggtggataaggacagtgaggtggtagcagtagattttcttgtgcttcatcttgagttatttgatccatgtaacattaacttggcccaagaggaggaaagtttttaagacattattttatttataaaaaattaaatcctccctgctacttttgatatgtaaatggtggctcatgcctgtaatcccagcactttgggaggccaaggcaagtggatcacctgaggtcaggagtttgagaccagcctggccaacagggcgaaaccccatctctactaaaaatacaaaaattagccaggcatggtggtgcaggcctgtaatcccagctactggggtgttgaggcaggaggatcgcttgaacctgggaggcggaggatgcagtgagcagagatcgtgccactgcactccagcctgtgcaatagagcgggactccatctcaaaaaaaaaaaaaaaaagttcattaactcagaaagactactccagaaattggcgagtggttactccaggaaggagaactgtctggctagggtgtagggattgggagaatttgttttaccgtacatccctttggaccaattggattttgtacatgtgtattttttagcctgttcaaaaaatgtatgagtttctggaaaattgaattaaaggataaaaataaaatatgaactttacttctcaacataagcttttgcaacatcaagatacttttgtaagcaatgatagcaactttttttcttttcttttttttttttttttttgagacagagtctcgttctctcgcccaggctggagtgcagtggcacgctctccactcactgccacctccgcctcccaggttcaagtgattcttgtacctcagcctcctgagtacctgggattacaggtgcacaccattacccctggctaatttttgtatttttagtagaggtatggtttcaccatgttggccaggctggtctcaaactcctgacctcaggtgagccacctgccttggtctcccaaagtgctgggattacaggcgtgagccactgcacctggtctggagtaaatatttatatggatataattagaactctcggtacttttttaaatgagttgtggtctgccccccctccccaacacacaaattaaacatatattaaggaagcaggttttcttcttccacttggctgtagaaagccaaaagcaacgtcactcccaccctaacaacaagaaacagccatatcaactacaaaaaacttgaattaattggaaagccacctagtagtatgaaatccaaagaaaaacaagcccctccaggaaatatgggaggtgaacaccagctctcctgtatcagagcatgtgcagaagagacattgggtaccctacaagcaggtaagaaaaattcaagtaaaaattgtagtgatttgtcaaaggtaaatgaaggctagcatgagactatggggcccctcaaatccacagacacaaagggaattcacactcatttgcaggattgtcttcacagatgtctgccgcatgctcacaggaaagattggaagcagggtgagggaccagacagagcctccctccatggtacagacctggagaaggccaccaccattaagggaaaagcatgaacccctcccactgggatctttctctcctggggaaggagtacaaaccctgtcaaccccagagcacacaagaagaccggctgtagctagggaaagagtaatagaaacatactttataaacctgagagaggagcaagaaaaactcctcatccaggatcctacaccaataccatgagaagacgctactactgtgaaaaggataataacgttgagaaagacccaaaccgtgagattaagcacaggattaagcacaaaatgggacaataaaaaaacaaactctgcctgccacctggctagaactcttccgataagagagaaaagagcatggacaaggacccctctgaggcacgggtacacagggaaggctgaaagagtggagcaagcacattaaagaaataccttccagggcctcagtccccactctaagcatagaattaaagggattgaagacagtagtacactgaaggcaattacggtaatgacaaaacccaaaactagctcagctcctgttaaaatgactaaacccaagagacatgcctatttccaaccataacaccttttggcctcagcctactattttacatgtgagatccagcattcaatcaaaaactaagacacacacacacacacacacacacacacacacacagagcaatcagactgagagatgacccagattttcaaattatcacacagagatttaaaacaactatgattaatatgttaaagtctacagtagaaaaggtggaaaacataggtgaacagatgggaaattttgacagaaataaggaagcttataagagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttcccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatcaaaacctgatttaagctgtcaccttaagaaaccagaaaaagaataaatcaacttaagtaaacagaagaaaggaaaaaacaaagatatgagaagaaattaaaaacagaaagacaatagaaaaaaattaatgaaaccaaaagctggatctttcaatacaattgataaacctctacctagacttatcaaagaaagaaagaaagaaagaaagaaagaaacatcacaaattactagtataagaaatgaaaaaggggacataatagatcctacagacattaaaagcatatctccattaatctgcaacatttatgccaggaaagggaccaaggaattccttgaaagatacaaactaccaaagctaacttaagaaacagataactggaatagttctatgatctctgaaagaaactaaattcctagtttaaaaatccgacagaaaattccaggcccagatagctttattgatgaattctatcaaacactgaaaagaagaaaaaatatcaattctatgcaaactattctagaaaagagaaagaagggaacacttcccaattcattttatgaagtcggcgtgacctcaattctaaaactggacagaagacattatgagaaaactacagaccaattccctcatgaacacagatacaaaaatactcagccaattattagcacatctgatccaggaaaatggcaaatttctcttaaaggctttaattatgctttaatcctgaggtgggatgactccaaagacaacaaatggcatctgattccagtctaaatgaagttctgatataaccgcagaattttatttaacttttcaaagctactttcagagaaaaggcacagtagacagtttaatttaggaaattaagaagaagattatatggttgttgaaacattagagaagaaacattagggttaaaagtcatccacagactcatgaacgctcactcaaagggtggtaagtctacctcctcggtatctaacaaagaaacataaagttactagcctacactaaaaaaactcagctcaattctcagtttccaagattataccaaaggcataatccctaacctgctttctgaacatatataagcagtctggtttaaatacttaccttcaatctggctagtttctgagcacggtttcttctttgactctgagttcccggttttctcatcaacatccaggagaggaatatagtctgtttttccaacagtttctcccacaacatcatcaaaggcctctgcctctagtgtggcaatgaagtcccgctttatctctccctcaatgtctggagatggttctgttaatgcatctgcaagactgaggtcagccattctgcaccactgcaactgcctggtgaagaggaaaaagatctttcatgtaacgagcactgcaaaaggaaaaacatttctagaaactcttgtcaattgtttgaaacaaacaaaagaatcaaaatctaagattttacagctagaagaggctccctcatttgaaagatgagaaaaataaagctaagaaatggacagtctgacccaaggtaactcaccgctagttactcttttctcacatttctgggggtggagggaggtggtggtggcaggacaaagcaattgcaattgtgtcctttctatttataagaaaagtgaggtgtaaaaaaaccccacaatcaacatatccaaagctatagccagtaagattcaaatcaggtctttacatagttacattactatcggacaaatgaaatcaactttcttgaccaaagactgtgagtatggatcttatcttggagtgagtacctgcttcttcatgaatcacttgtggatagtcctgtcaaccaaactacttagccctgccagcataaaaaaaaaaagacacgtttccctcaattagctaagggagatggtccctctctgtagtcacgtatattaccatttttacagactaccagcttcttaattacataatctgcagttaagtaaatctactggcagccataaaaaagaacgagatcatgtcctttgtgggaacatagatgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtgaaccgaggttgcgccactgcactccagcatgggcgacagaggaagtctccgactcccccatcaaaaaaaaaaaaaaaaaaaaaaaaaagagccaaaggcctgcaataaattgggcaccattcaaatgcagggcataataggaaataaagtgtgcaaggtactacgcctgctttcaaaaagtctaacagaaactccaagagactccataggataagttgacatataagctatgttgttgacaaggtaaatacaagtcaaacagatccttagttgcacaatgtaatggccactacttgtgtttgtccagaaatctattcttcctatctcccctaatacaaaccaatccctacccctatagggtttgggacatgactagagttgggtcaatcagaagtcaagaagaagacagttggaaaggatcatttattgactacacgctggaagaaaagtccatgagtgacagctatttagttgccctggttgactacttcaagtctaagtgagcggccttcatctttcttttgcctaatttagccaatctatttctgttgtttacaatggaagaatctcaactaatacacagtctttctccaacccaaacttgaaaaagtaaaaatatactatgattcaagccacttaattttcaggctttcctttcaagctgttatccaccgtctacctctctccaacaaatgtacttaggaaaaagaaatagaattaaagcaaggaatatggtcctatcttccttccttcttattttatcttcatctttgttcccacacactcctctcctcccacttacatgctgtgaggctaccatgattacaaaacatgtacaaagcaaatacttccagaccctgaaaaatcagaagtcatcgtacccccaattcccaaatccaacaagcaaagggtgttgctatatattagagtggtggcacagaggcttaagaatcaagatccgatacccaaataagtacagacaggataattaaggccaggggcaagatctacatcttctaggcaagtgtctagaaaaaaaagatagtatgtgttcagtactgggaatgctggagatagtttgtctctacctatatggagcttagtgaaaacattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtcttgcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttcttaaagcaaatgtgatatttaaatttcctgtgactatactaatgagttcctaaatcatatctttttattttttatttttttcagacagagtttcactcttgttgcccaggctggagtgcaacggcaccatctcagctcaccggaacctccacctcccaggttcatgcgactctgtcatcatactacttggaatttgatgaagttcatttaggtctcaaaaaatgtcaaaagatacgtgtgacccagatgtggtggcatgcacctgtagttctagcctttcaggaggctggggcagggagattgtaactaggagttccaagctatagtgtgcaatgatcacgtctgtgaatagccaccacaactccaggtgtggagccacgattgcatcactgcactctagcctgggtgacagagcaagactctagtctcaaaaagaaaaaaaaaagaaaaaaaaaatcacactctgagccaggcgtggtggttcacacctgtaatcccagcactttcagaggctgaagtgggaggattacttgagactaggaattcaagaccagctaggcaacatactgagaccctgcctctacaaaaactaaaaaaaaattagctgggtacggtggcatacacttatagtcctagctactcaggaagctgaagtgtcacaatcgcttgaacccgggagtttaagactgcagtgagccatgattgtgatggcaccactgtactccagcctgggtgacagagtgagaccctgtctcaaaaaatttttaaaaataaaaataaaaaataaatagggtacagaggctcatgcctgtaaccccaacaatttgagagcctgaggcagctggatcacttgaggccaggagttcgagaccagcctggccaacacggtgaaaccccatttctactaaaaacacaaaaattagctgggcgtggtatcacatacttgtggtcccagttaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaatttaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagttttgggacttggactggctttcctcgctcctcagcttgcagacagccttttgtgggaccctgtgattgtgtaagtcaatacttactaaattcctctttttataaacatacatatatatcctattagttctgttcctctaagaaaactctgaccccagactaacacagactctggtaccaggagtggttccagaggaacagaatgttaaggatggagttcttttgttggtttgggggtttctggagttggctgcttaatatgattgatccaaaaatgctgaggactctacttctaatagcatggagaacattcatagtccttggcgtgaactatttagagagttatgcaaaataaatgcatttgacactcctgattcactgctcatgaaaggtaaggactttagtgactctatacataatacctttgaccatatgtggaaaaccaacgaacataatgaagctggttggttgctcctaagttcagtgaacaaagtgatgaaagaaaatgatgaactcagggattctgtttcctggcttcagaagcagatactgagtctcaaatctgctaagattgccctgagtgagagtcttagctcctgttgagaaagagctgaaattgtggaaaaacagacataagctcttatcatgcgagtggctgacctgcaacaaaagatgcatgcacagccacctgaggtgtctactgctaaagtgagggcattgattggaaaagaatgagacccagaaacttggaatggggatgtgtgggaggaccctgatgaagctgggaacactgagtttataaactctggtgaactttttttgccagaaggaacagcttccccatcccccatagtggcagcataaccccccatccccgccatcaacctttccatctttgtctacggacataaaccctgagctgcctgaggcaagagtcatggcctcctctcaggcagttgccaggcaagataatgttgattctccttagaaggtacctgcaacacccatttgcttctagacctataactcaagtcccacaggtccctagaggtgaggttgagagtgtgacccaggaggaggtgcgctacactcaaaaagaactgttctcggccaggcacggtggctcacgcctgtaatcccaatactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctggcaacagaacgagactccctctaagaaaaaaaaaagaactgttctctaatttatataaacagcaatctggagaacaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctactcatcccagctgggagggtccagaagatatacccttgaccaatgccttgtgaaatagatttgtgagggcagcacttgaatctttgaagagccctgtaattgctcttctctgcatgtcagacctaatggtgagaaccgcagtcactcaattacaaaattgaaatacgaggggaataactggatcccaaggtggcaggggccaagtagcagcactcaaccatcaaaggcaaggtgggcgtagctaccgtaatggacagcagaggcaaagtgacaatcagaatagtctgactcatgtagagctctggcattggctaattaatcacggtattcctagaagtgaaacggacaggaagcctactgcattcccacttaatttatacaaacacaaaacttctaggtcgaatggacaaaagactaatttgaattataaaaagagaatcatggcccctcactcaatccatttccagacttcagccagtttacagacccagaaccccttgaatgaaggggaggccaggtacccttgagaaaggaccccactactttactgacaatttatgcagtgaatctttctcccatccttccccaaggagacctccatccaacctttcactttggggactactggacactggctctgggctgatgatgactccaggggacttaaaacatcactgtggtcttccagttaaactaggggctcatggaagtcaggtaattaatgaagttttagcttaggtctgacttacagtgggcccagtgggtccctggactcatcctgtggtcattaccccagtgccagaatgcataattggcatagacatacttagcagctggcaaaacccccacactggctccctgactgctaggttgagggctatcatggtgggaaaggccaaatagaagcccttagagttgcctctacctaaaaaaatagtaaatcaaaaacaatatcacatccctggaaggtatgcagagatcagtgccaccatcaaggacttgaaagatgcagaagtggtgattcccaccacatccccattaactctctcatttggcctgtgcagaagacagatggatcctggagaatgatagtggattatcataagcttaaccaagtggtgactccaattgctgctgctgttaccagatgtggtttcattgcttgagcaaattaacacatctcctggtacctgctatgcagccactgactctgcaaatgcctttttctctattcctgtccataaggcccatcagaagcaatctgccttcagctggcaaggccagcaatatacctttactgtcctacctcaggggtatatcaactctccggctttgtgtcataatcttatttggagagatcttgatcgcttttcgcttccgcaagatatcacactggtccattacattgatgacattatgctgactggatccagtgatcaagaaatagcaaacacactggacttattggtgtgacatttgcatgccagaggatgagaaataaatccgactaaaattcagggaccttctgtctcagtaaaatttctagggatctagtgttgtgggacctgttgagatattccctttaagttaaaggataagttgttgtgtttggtctctcccacaaccaagaaagaggcacaatgcctagtgggcatatttggattttggaagcaacacgttcctcatttgggtgtattactccggcccatttactgagtgacctgaaaggctgccagttttgagtggggtccagaacaggagaaggctctgcaacaggtccaggctgctgtgcaagctgctctgccacctgggccatatgacccagcagatccaatggtgcttaatgtgtcagtggcagatggggatgttgtttggagtctttggcaggctcccataggtgaatcgcaatggagacttctaggattttggagcaaggccctgccatcttctacagataactactctcctttttttttttttttgagacgcagtgtcactctgttgccaaactggagtgcagtggtgcgatctcggctcaatgcaacctccacctcccaggttcaagcgattctcctgcctcagcctcccaagtagctgggaatacaggtgcgtgccaccacatccagctaatttttgtatttttagtaaagatggggtttcaccatgttggccaggatggtctcgatctcttgaccttgtgatccgcccacctcagcctcccaaagtgctgattacagctaactactctccttttgagagtcagctcttggcctgttactgggctttagtggaaattgaatgtttgactatgggtcatcaagtcaccatgcgacctgaactgccctgcctatcatgagctgggtgctttcagacccatctagccatacagtggattgtgcacagcagcattccatcatcaaatggaagtggtatatacgtgatcgggctcaagcacgtcctgaaggcacaagtaaattacatgaggaagtggctcaaatgcccatggcctccactcctgccaccctgccttctctctcccagcctgcactgatggcctcatggggagttccctatgatcagctgacagaggaaaagaagattagggcctgcttcacagacggttctgcatcatatgcagacaacacccgaaagtggagagctgcagcactacaacccctttctaggacatccctgaaggacaacaatgaagggaaatcttcccagtgggcagaacttcgagcagtgcacctggttgtgcactttgaatggaaggagaaatggccagatgtgtgattatatactcattcatgggctgtagccaatggtttggctggtcagggacttggaaggagcatgattggaaacttggtgacaaatttggggaagaggtatgtggatggacctctctgagtggtcaaagacaagatatttgtatcccatgtgagtgctcaccaacaagtgacctcagcggaggaggggtttaataatctagtggataggatgacccattttgtggacaccactcagcctctttcccctgccatcgcccatggccaacaaagtggccatggtggcagggatggaagtaatgcttgggctcagcaacatggacttccactcaccaaggctgacctggctacggccactgctgagtgcctaatttgccagcagcagagaccgacaccaagccctcagtatgtcaccattccttgggtgatcagccagctacctggtggcggattgattatattggacctcttccatcatggaaagggcagaggattgtcctcactcaaatagacacttactctggatatgggttcgcctatcctgtatgcaatgcttctaccaagactaccatttgtggaatgtttttttggtttgttgttgttgttgttgttgttgttttgagaaggggtctcactctgttgcccaggctggagtgcagtggcacaatcttggctcattgcaacatccgcctcccgggttcaagtgattctcctgcctccgcctcccaagtagctaggattacaggcacccgccaccacacccagctaatttttgtattttcagtagagacagggtttcaccatgttggccaggctggtcttgaactcctgacttcaagtgatctgcctgcctcggcctcccaaagtgctgggattacaggcgtgagccaccgcacccagctgactcatggaatgccttatccaccatcatggtatgccacgcagcattgcctctgaccaaggcactcactttacagctaaagaagtgcggcagtaggctcatgctcatggaattcactggtcttaccatgctctccatcatcctaaagcagctggattgacagaacagtggaatggcctattgaagtcacaattacaacgccaactaggtgacaatactttgcagaactgtgggaaagtcctccagaaggccgtgtatcctctgaatcagcgtccaatataaggtactgtttctcccatagccaggattcacaggtccaggaatcgaggggtggaactggaagtggcaccactcaccatcacccctagtgatccactagcaaaatttttgcttcctctcctgcaacattatgttctgctggcctagaggtcttaattccagagggaagaatgctgccaccaggagacacaacaatgattccattaaactggaagttaagattgtcacctggacactttgggctcctcctccctttaagtcaacaggctcagagggggagttacagtgttggctaaggtgactgacccagactatcaagatgaaatcagtctacaacttcacaacggaagtaaggaagagtatgcatggaatacatgagacccattagggcatctcttcgtattaccatgccctgtgattactgtcaatgcaaaaccacaacagccaaatccaggcaggactacaaatgatccggaccattcaggaatgaaggtttggatcactccaccaggaaaaaaacccatgacctgctgaggtatttggggaaggcaaagttaatacagaatgggtagaagaaggtagtcatcaataccagctatgaccacgtgaccagctgcagaaatgaggactgtaactgccatgagtatttcctccttcatttgttaaaaacatgtttgtgtatgtatacacatgtactaatatcttcactttatatttccttttcctttatcatgtgacataagatttattgatttcataacagcatttaagtattattaactttatgtaatagtatttgggttggggattggtgtgtttctggttgtatgaaggatagttttattacattaggtgtaattatgaccttattattgtctttattttaagattacatacgatctcagatgtatatgggttcaagttgacaaggagtggacttgtaatgttaatactgtcaacttgattggactgaaggatgcaatattgatcctgggtgtatctgtgagggtgttgccaaaggagattaacatttgagtcagtgggctggggaaggcagacccacccttaactgggtgggcaccatctaatcagccaccagcgaatatagagcaggaagaaaaacatgaagagatgggcctagcctcccagcctatatctttctcccgtgctggatgcttcctgccctcgaacatcggactccaagttcttcattttggggactcggattggctctccttgcttctcagcttgcagacagcctactgtgggaccttgtgatcacgtaaatcaatacttaataaactctcctttggagatatatcctattagttctgtccctctaagagaatcctgactaaaacaagtagtgtggggctcgtgacaaaaactgatagctttgctgccaaaggggctcctgtggcatgacagagctgttgtccacagcaaatgccatctcacactactggaattataaattccactatttgaataaccactgccgaattcaggatttagcagcttttctgaaggaaccataaataggaattcaatggttcctatagtaggaactggacttggtaatcccagcctgtaatctcccagcactttgggaggccaaggcgggtggatcacttgaagccaggagattgagaccagcctggccaacacagtaaaaccctatctctactaaaaatacaaaaacagaataactagctgggcactgatttttattatttagatggtatgcacctgtaatcccagctactcaggaggctgaggcaggaaaattgcttgaacccaggaggtggaggctgcagtgagccaagatcacgccactgcactccagcctacgtaacagagcaagactccgtctcaaaaaaaaaaaaaaaagttcctatagtagtagtggcacacctgtgacccatttacaacagacgaatgtgggtgggaagccctattctatgctcgtccagcctactttacatataaagtattattgtaactccagatcatgacagggaaaatgctgagaaatgagttcattaaagagcttttaaaagcctaacagattataatgtcaaagggttccatgaaaagcaactattcagttgcttttactattcggttatgccatttccctattctatctctgacaactattattagtagttatcctttgggagctgttatgaaccaaaaactaaaaaggacgtctgtaactagttttgatagaggcaagaggcaaacaaatgtctaggcagacaggggcgggtcctcagtgaaacccgaactttaatccggaaactgtcctgggtaaatcctgagatcggattaagaacctgccttcccgtttggcatgattgatccccatccttcacctatttaacctgtacctaccctttcctaattggttttctacactgtcctgcccaccttggagtggtgtcttcgctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatctgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttgttttttttttcccagaaatccccagttttcaataaattaaagcgattatccaattttatagttattttattctgaaacatgtataagtacaatacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccatacagataataaagttaactttaaatagatttgtgagtaagagtcaagagaatttgaaagctgggtacagaagtctgtatgctttactgaagcaccagtttaatctgacactcactgtggccttgaatgagtcacctttcagggctgagttctctaatctgtaaaatgagagtgttatgttaaatgtttactgaggttgattattctatcagctacttgtaattcagctgcatcatttcagttagctataaataaaccccctaagaccctcagtgtgaatatgaacaactatcatttcatattatttcatatatcaagtattctcatttataattgggttgaggtttattaaaaaaaaaaaaaaaagctttttggcaaagggagggactgaaaacaaattcaccactgcatggtgccctgcttgagccaatctgactggagcttaagaaactccacccagttctggctaacatcaaaggagactcaacaccactctgccagaaaataagccctgtattatctaaccaggcactaagggaacacacagttttcaagcacagcactttgtatatctgatctttcattctgatgacatgcctgaagtgaaactattagtgagccgggttttttaaaataggtaaactaaggcaagaggcaactacatggcatgatgataaaatactctcttgactacaatctcactattaagagctaggtgctcataaacaggaaataaggatatatgatgaggccacagtactttgttgtatgctttactttggatagttcacaaactctggaattaattactgtactaaaaatattttacaggtctatacagattaaacagtgttaatatctaacttaattacacagaagttctgaagaaccttttaagctccatgaagtcctcctgaaaattttaggtcattcgcatctagagccactcactcggggtctgtgctcattctgtctgatgagaaattggcaatctggtttaccaatggcctgttgctgtctctgtcctcttctattcaccccttgaaaggtgctactatgggagctaaaatgcagggaaaaaactcatgaaaagctagaacagagcttgggcaaaatggcaaaaccccatctctacaaaaacatgtaaaaattagccaggcatggtggcacatgcctgtagtccctgctactcaggaggctgaggtgggaggactgattgagcccaggaggttgaggctgcagtgagccactattgcaccactgcactccggcgtgggcaacagagtgaaaccctgactcaaaaaaaaaaagcaagaacagaagcctgattcccaccatcatactcacttttcctaaccactgtgttaggaaaccttcattttactgtgtcacattagccaaatttctaccgacattcatttgcagtagccagcattctctttttaaaagtatagaatcctatttcttaatttaaaagtgggtaagaaaatgtacatccctggaaagaccattgttcatcccagagatggttctattgaagatgtctgagttcttggttctggtgtgaaaaaggaagaaaaatattatggcaacatgggaactttcagggaataaagcagatatagatatggtatcaaagtagggaaagggtatacaggcccaggagccctaggaggcaaaagaaagggagttaataccatgccaaagacaagcttgctatctttcaaaatatcgcctcctgtcagtttcagcagaaagaaataaactttcttctcagtgacctaggctactttgaggcaaatcattttgagttccaaacaacccatttaataaactttaaataattattactaaaggtaggatactgcttataatgctcacttatattttctctataactgatagcctgtcctttttgggtgggtgggggcgggggcggttatggacaagacaaggaaccataaagatatctgggttaatgttttcttttatacgtttgtttttgcatgacatttaaatgacagagaattctaaagccaacactaagctgctatcctaggacattagtgagaatgctgtggccaaaatatagtgctcattcctcaggcttgaaaggaaccccacgtcgccagtgtgggagatcatttataatcttgatggatacaggtatagcctgcttcataataatttaatattcaacatcagatttttttttagtatgcctagcaggtttttagttactaattaactttattacccagatttgtttcttactgaacttctttcagaggcctgttatacatcaagctgaactttgtctggcagctgtgctgtttttaatttatttaaccacaaaaccttgatttatactttcaagcaaaatgatattttacttaaaaataaatctttagcaaggatgtctacaggaatcaactaccaacttacacagttcacagacacatatgattcctcagacaaatctgaatttctcctgcttctcctccaaaccagacttgcagatagcaacagacaactgaggaagatcttgactatcctgagcaataaactacaacccccctgaagaatatattaactgtccacccctaggttcctccctacacagttcaaggacaacagctgtgctattacaaactgatggaatttccaggcttgacagggttctgttcgtaaccaccatttgtcctgttcatcataggattagcaacagcagagagcccttgattactagaatagctgaggccatcacacagctacattcctacatgaaagaacacactgatataggtttaaagaagttatattttactttcatgtagttaccagagtcccccccaccccccatttaagggagccctgttctctggatataaaaatactgtatacacttgcacacacatactcacatacataaaaccttgcatcacaaagttaaaaggctaccttgcttacttacaggaactatccaggcagcttgtgttcagtcctgactaaatgcattttggatcaggcacctgccttcaacatttctgtccaaatgaatttcaatctatttctccaggaagaacacaccagatacctcccactgttagccatgtgatacaggcagcatgatgtctgaagtctggttacggttatgtaggccaaaataagaaatgacaatgacacagcacttacatttctgatatcaccaaccttaagaatgaatcttccattttatctaaattttttaaatgagtaaaactttaaaagattcttaatacctaacccctcaaaattttgaaaaaggagcattttttttaaactttacatttatcccacttccttcctctaacacaggaaaacattcagagttaatctataccaatccaaaaattatttctaaccacattctaaaggcattttttttttttttgagacagggtcttggcctgttgcccaggctggagaatgcagtggcatgatctcagctcactacaacctccgcctcctgggttcaagtgattctcctaactcagcctcctgagtagctgcgattgcaggcatgcacaccaccatgcctggctaatttttgtatcttcagtagagacgaggtttcatcatgttggccagactggtctcaaactcctggcctcaagtgatccacccatcttggcctcccaaagtgctgggattacaggcatgagccaccatgcctggctctaaaggcttacaccagttgaactgatctaggatccaatcccctcactttaatagatggaaaaaaaaatgagaaatggaaaaaacaagtcacttacaaatgaggctgagacaaaggatcggcgaaaagagccacagaacaccaaaaacagaagcagagcgtgacaaaataagcaaaaccttacagttttgtagtttctgcttttatctaacacaatgacttcgctgtacttcatataccttttgaattatacctgcttatacatacctttacctacctactacttatacctacctatcttttcttctgcaaggagggaggcaggcaggaagaatcctgaacatcaggaaaacattccacctgatctttaaagggaccccaatgcctagatgtctttttcttttttctttttttttttttttgtaaatccaaactcttacgtgtaatatcaaggctgactgacaagactcagtcctatcacccaccataatcatcagcagctttccatgtagggtctccctacaatttagtcacatgggaccatctaccatcttacattatcactgtacaccctatgctcatttgctctccaaacttgaagttatcttctctccctcctcatttgtgaaagtcttgaaatcaaggtccacataaattgtcttaccaccttttctgtgactgctttttagaatctttctcccagtagtattcagaactaatacatcatctgtacttgtaacagtagagtctgatctatactgtagttcagtggtccccaaaccttttggcaccagggacaggtttcgtggaaaacaatttttccacagatagcaggaggggtgagagggaggagatggtttcgggatgaaactcttccacctccgatcatcagtcattagattctcacaggagcatgcaacctagatccatcgcatgtgcagttcacaatagggtttgcgctcctatgataatctaaaaccactgctgatctgacagaaggcagaactcaggcacacttatcgcaaagttaatgtaatgctgttcacctgctgctcacctcctgccgtgcagcccagttcctaactggccatggactggtaccaatctacagaccgagggttggggaccccccactgtagttagttgtatataccagctcctgtaaactgctgggtcccagaagagaggaccacatcaaagtgatgtgcacaccttctctgttcctagtagactacagaggagacaggccaaaatgataaaaaccaacaaaacaaggggctaaaaacacatttctaaaatgacacgatgaaagttattagaaattgaatctaatttgaaattaatcagaagttccaaaattacaaaaactcttcacaactagaaaaagaataaacagattcaaggctgaaaggttatcaccaattacaaatattcaccttggctaggtgtggtggctcatgcttgtaatcccagcactcagcactttgggaggctgaggtgggtggattatgaggtcaagagattgagaccatcctggccaacaaggtgaaacccctctctactaaaaatacaaaaattagccgggcgtggtggtgtgcacctgtagtcccagctactcgagaggctgaggcaggagaatcacttgaacctgggaggtggaggttgcagtgagccaagatcgtgtcactgcactccagcctgggtgacagagtgagactctgtctcaaaaaaataaaaataaaaaagaatattcacctattttcttccactttctaaacacagtttgtacaagagcaagcatgttgtctggaattatagaaagaaagccagtaaggagtaaccgtacgaaccagctctccatgctggtcatcttatcattattaggcatagcaataaaaatagctctctctgcttttagaaaagcatgacatgatgcaatgtggcaaaaacaaatattcaagatggtcgaccagttactggcctggcatggtgactcacacctgtaatcccagaactctgggaggccaaagcaggaagaccacttgagcccaggaattcaagactagcctgggcaagatggcaagacaccatctctacaaaaaaaaatgtttttaattagctgggcatggtggtgtgtgcctgtagtgccagcctctcaggaggctgaggcagtaggattccttgagcccaggagcttgaggatgcagtgagctatgattacaacactgtactccagtctgggcgagaaagtgagaccacatctctgagggacagagagagaaagagagaaagatatcagccactaccatcatgttaatatgatcatataaatattaaaactttataattattaaaatattaaatctctatagttatcagctcatatatctgtcagaaagtaataagcatatcatgtaactttaggatgacttagtgctgaggagattggaagaaaggaagaatattcatacttgatcagctcttagcttttgagaactattttattaaagaaaaaactctcttttggctgggcatggtggttcatgcctataatcccaacattctggaaggctgaggcaggaaaactgcttgagcccaagagtacaagaccagcctgggcaacacagttgagactgcgtctccacagaaaacattttaaaattagcctgcacacctgtggtcccagctcttgggaggctgaggtggacggatcacttcagcagaggaagttcaaggctgcagtgagccgtgatagcaccactgcactccagcctgggctacagagtgaggccctgtcttgaaaataatagataacaaaagaaaaacttctcccattaagcaaagtgaagtttcactctattttatatcagtgaaaataaagaaaagtggaaggtagaagaggacataggaatttgtgctgccaattctataatttttgttttgttttgttttttgtggggtttttgagacggagatttttgtatttttagtagagacagggtttcaccatgttagtcaggctggtcttgaactcctgacctcaagtgattcgcctgcctcagcctcccaaagtgttgggattacaggtgtgagccaccatgcccacccttgtaattgtttatttacaatgtgtgtcccacccagagttccccttaacgcttgagttcctcgatggctaggatagcatctttctcaccttttatcctggacatctaaatataataaacttgaaacctcacaggctctcattaaatgcacatttgtcctgctaggtgcgctctgctccataccataccagccttctcttgctggggttgatgtttgcacagctggaagcaccctcatagttcttctaagtattggttctaggcacgactaagggtagagtagctcagcttttctgagcaagaaggagaagatacaaactctatgggagtacttaacaagcattttgtagtcgtggcaaaggccttactttgacctaatatcttacagatgctttcaaaaaggagggggggaatatcattattaaatgaaaattgaacagcaaaagttgaagagatctttcaagttattagtaacataacttttaatattttacctgaaatacaagtaaaaatctgaattaaaagtattaaaaaaacaaaaaaaacacgctggatcagaattgttcagggacagggttaagcaatatgagtattatttgttgttgttgttttgttttttttagagacaagtcacactatgttgcccaggctggagtgcattggctagtcacaggtgtgctcattgtacactacagcttcaagctcctgggctcaagcgatcctccagcctcaacctcccaggtagctgagactagaagcatgtgctactgcaccaaaaatctcagtgttgttggttttcttgcagtaagggtaatcatgacacagagaaatctcattaaagttgagtccgagaggcacccacaattgagggtcactgaattaatcaacaatctacctaatccattcaagataaaattcactgaaatgaaatgcaacacaggattaatacaacttaacaatagaaagacatcacactcccccttgttaggaaggtgttttagaatcagtttactagatgtagaatctgaggcacggatttttgtacaagtgatttactaagggagtgcttttaggaaaaacctataaggttttattttattttaaggttttatgatattttaaaggtatcaactatccccaaactaatctatagtttttgtttgtttttgtttttttttttagacagagtctcactctgttgcccaggctggagtgcagtggcacatgatcttggctcactgcaacctccgcctcccaggttcaagcaattctcctgcctcagcctcctgaatagctgggaccacaggcgtgcgccaccacatccggctaatttttgtatttttagtagagacagggtttcaccatgttggccaggctgttctcaaactcctgaccttgtgatccacctgtcttggcctcctaaagtgttgggattacaggcgtgagacaccacgcccggcctaatctatagatttaacataaccccaagcaaagtccagtaggttttttcttttcaaatcaaactgaaaagttgatcctaagttttacatagtaatttaaaaagtcaagaacagctaagataatctttgagaacaaacttagaggaacttaaactactggatatcaaaacttactgatggattgaaccatgtgaaaatgctgaaaactgatgagtttctaacctatggcaatgtcatatgtttgaaactaaaaatacataaatatagtaatgaaaacattgtggtacctgcacaatcaccaagaaagaggccaatgtacttggtgtgctgaacatatggaaaaacaaaacaaaacaaaacaagaggccaatgcaaaaaaatggttttgaaacggaaccacatgcatatggatacttaatatctgacaaatgtgacactgcaaaatagtgggggaattaactgtcttttcaataagtggtgctgggtcaactggatattttgagctctacctcacagtatatacaaaaagtaattccaggtggatggcagccctaaatgtgaacggtaaacaataacatggcgaatattttcatgatcacagaggcagatgaagaaaacgaacagacaatggagagagtagagagacagggacaaaagaaggaaaaaagaaaagcaaaaagaagatgatgaggtgggaggatcatttgagcccaggaatttgaatacagcctcggcaaggtggcaagaagggagggagggaaattcccctcagcagtacttaccaacttacaagaaacagatgggcttatttctaattgtaacactaaatgattttttttaaaaaatgaagtgatgcctttaaaactgagaaaaactattttgaagctagatttttacagccaactcatccattaagtgaaggctaaaatgggaaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagtgacactccatctcaggggggaaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattatatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctctaagtctgcatgtgctgacctttaaaagacagtataaggtttgtctgttttcccttctgctagcaggctgctagactgaacatggtagacaatgactttccctctgaagttggctgtgttcaatattctattgtttttcttatacaagcactgggagatttttgcaattgatgtatttttaatcatttaaaactaagcaagccatgacaatataaaagacaaacttacaccacaaatgaaactactaacaaaaataacaaatatactcatctggggatggcaggggttggggggagaccctctcctaaacatagcaagcaccaaagggctgctttgacttgcaatactaaactccttccaagaaatttggaagtaaattcagagtaaccaaagatacaaaaagcaatatgcaacaggagaaagtatttgggtgtgaataaagaatcaaaaaatgggccaggtgcagtggctcacgccagtaatcccagcacttggggaggccgaggcaggtggatcatgaggtcaagagatcgagaccatccaggccaacatggtgaaatcctgtctctactaaaaatacaaaaattagctgggcgtggtggagcgtgcctgtagtcccagctactcgggaggctgaggcaggagaatcgcttgaacctgggaggcagaggttgcagtgagctgagatcacaccactgcactccagcctgggcaacagagtttgactctgtctttaaaaaaaataataaataaaaaaattttaaaaatgtacaaaatgaaagggaccgtggcaaagatggggattctgtttcttctccctgggtgctcagaaagacatttcctatttcccttggagttagaagttgagaccatgtgagtgggttctagacagtgcaatgtgagctgaagaattatgcttcactacaaagcacttgatgaaattctgcttgctggtgctctttgctatcaaccaactaaatacaaagaatccagcaggagactccaagacaccagatggaaggagttgaaattcctcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcacaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgatttcatatggcttgacttaatagtaaatgacaagcactgcatttttagaaagcgctaattttattaggtatacatacctacacacttttttttttttttttttgagacagagtctctgtcatgcaggctagagtgcaatggtgcgatctcggctcactgccacctctgcctcctgggttcaagtaattctcatgcctcagcctcccaagtagcgggcagtacaggcgtgcatcaccatgcccagctaatttttgtattattagtagagacgggttttcaccacaccgggcaggctgatctccaactcctgacctcaggtgatctgcacacctcagcctcccaaagtgctgagattacaggcatgagccaccatgacatctttttacaagaagaaataatatgctgacttggccaggtgtggtggctcacacctataatcccagcactttgggcggtcaaggcgggcagctcacctgaggtcaggagttcaagaccagcctggccgacgtggtaaaaaccctgtctctactaaaaatacaaaaattagccaggcgtggtggtgcacacccataatcccagctactcaggaggctgaggcaggagaattacttgaacctggaaggcggaggttgcagtgagccgagatcgtaccactgcactccagcctgggctacaagtgcgaaactctgcctcaaaaataataataataataataataataataataataacaataataataatatgctgacttagaggctcctggactattgtcattagaactataaagcaaagtctatacatctgaagagaaatttcttttaaatatactcttctcctgtgtccttactgctttgtattaccttacaaagaaactactacatatacaatttcagctaatgaacataaaggatcaaaattagtgactattaggccaaatgttttggccaaaattgttgcaattaccatgtaaacataaatcctgcttgcctattattccatcagtttatacttccacttaatcaaggatttaagattgagtttgccttgtcaggctcacagaggcttaaattacttgtaaataaacattcccacaagagactacatcataaacgctcatatttattacatcccactcaaatacaacagtttctcttttaaaaattggcaatctatacaaaacagcaatttagattggccttcaggacagagaggtatgattcttagtaaatcacattacatcaagatgctttattctgaagatgtaagaaacgaatatatttttacaaaaacactatatgtcaagtgaatatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaataatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctattcccaaagcacttaagactagtaagacttcctgaagtctccaactcataaatggtcattgtttcacagctcaagtaaatacatgtatgaacatgtaaaataaaaaagagtaagggagaaccttaaattctccagtttactctcaaattttaaaactcagaaaagagagatccaaagtggtttccctttgccaaaagccatctagaaaactagagacaaagctacaattaggacaaacatctcccaactcccaccaagcccagagttccctccccaaaatgaatactcactgaacccacaagagaagcaccagttcagagtgcaaacctaggtcaaacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatcgtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttgggaggccaaggtgggcagatcacctgaggccaggagtttgagatcagcctggccaacatagtgaaacctcatctctactaaaaacacaaaaattagccaggtgtggtagcacacgcctatagtcccaactacttgggaggctgacgcaggagaatcactcaaacccaggaggcggaggttgtagcgagccaaaatcgcaccactgtactctagcatgggcaacaaagcaagacaccatctctggggggggagggaaatttgcaggagtttaagtacgacacagctgcactaaagctatttaaatcaacatcaactctaaacatttcttattggtagtagaattttggctgggttttagtggcttggtttaactaaatcacaaagtcagtagacaggaaaggtgtgagagggagagaaatggaaaacaaaagtaccacaaaatggctgggcacggtggctcacacctgtaatcccagcactttgggagggtgaggcaggtggatcacaaggtcaggagttccagaccagcctggccaagatggtgaaaccccgtctctactaaaaatacgaaaattagctgggcatggtggccggcgcctgtagtcccaattactcaggaggctgaggcagagaactgcttgaacccaggaggcggaggtggcagtgagccaagattgcgccactgcactccagcctaggcaacagagtgagactccttctcaaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaacccctgcctcgataaaaaatacaaaaaaggttagctggttgtggtggcacacacctgtagtcccagctacttgggaggctgaggtgtgaggatcactggagtctgggaagttgaggatgagtgagtcgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctgtctctactaaaaatacaaaaattagccaggcgtggtggtgcacacccataatcccagctactcgggaggctggcatgagaatgcttaaaacccaggaggcggaggctgcagtgagccgagatggcgccactgaactccagcatgggtgacagagcgagactctgtctctaaataaataaataagtaaatgcatatttttttaagtcttacttccctaggaagcaataatcactaactcctttttcagttttgtcaatgacctgaaaagcttggtcctgacacctctgctttatggaaaaggcaagaatgcatactgattcctaaggtagtaatctgaacggtttaaaattccatacatgtagctacagacaactagtataatggcagagatcttacatgatattttaagatctagttccagtagtaataaaatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaatatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttcaggggacaccccagtaaagcaacagcatacctcacacccagatgctggtttctaataccattctctgataaagaaaccaagactctttggagaaatgactaattctaggactgagaacaaaatattcaagatgagcctgaagtaccttgtatttccagaaagttaggaagtgctaaaaataaaaataaaaaaaaaaaaacaacgataggggtaagttggccggacgaggtggctcaggcctgtaatgccagcactttgggaggccaaggcaggcagatcacctgaagtcaggagttcaagaccagcctgaccaacatgattaaaacccgtctctataaaaaacccaaatattaaccaggcatgatggtgggtgcctgtaatcccagctactcgggaggctgagacaggagaattgcttgaacccaggaagtgtaggtagcactgagccgagattgtaccactgcactccagcctgggcgacagagtaagactccatctcaaaaaaaaaaaaaaaaaaaaaaaaaagataggggtaactcaattacacaggagtcaactaaaaaagttcccaatgaccaaagctggaacaatataaacaatagactgaataaataaatgagagagaataagcaagtcttcagtgaagaattccaaacaagatactccacttccaagaggtagaacataacccttcatcctttacatgtgcatagcacatagtgacctccttctaaagagtacaatatgaaaatgggaggggggggtaagagaaatatgacaaatactacctaagccaagtgatcaagactaatatcaatagtgataaatcagctgggtgcaatggcttacatctgtaatcccagcactttggcaggccaaggcaggaggttcacttgaggccaggagttctgacaccaacttaggcaagcaacatggcgaaaccccatctctatgaaaaatacaaaaattaggctgggtgcggtggctcacacctgtaatcccagcactttgggaagccaaagtagggggatctcaaggtcaggagattgagatcatcctggctaacatggtgaaaccctgtctctactaaaaatacaaaaagttagctgggtgtggtggcacatgcctgtagtcccacctacttgggaggccgaggcaggagaatcacttgaacccaggagacggaagttacagtgagccaaggtcgcgccactgcactccagcctgggcgacagagcaagactccatctcaaaaaaaaacaaaaaaacaaaaaaattagccaggcatggtggtacgtgcctgtagtcccaactacccgggaggctgaggtgggaggatcacttgggccctggaggccagggttgcggtaagccacgatcgtgccactgcaacccagcctgggcaacagagcaagactctttctcaaaaaaaaattagctgggcttggtggcatgtgcctatggtcccagctatttgggaagctgagttgagaggaagcttgagtcgagtccaggaggttccagtgaactgtgatcacagcactgtactccagcttgagtgataaagcaaaacacacacatacacacacacatacacacacacacacacacagacataaatcatgctgacatgatttgatagtatgcacccttgatataatgtgataagagtggcactttacctctgtgatcttccttctaaaaagcataacctctgtctaatcatgagaaaaagatcagacaactcccaactgaaggacactctacaaaatatcagaccagtactcctcaaaactgtcaaagtcatcaaaaacaagggaggtgtaagaaactgtcatagccaagagaaagctaagtatgataactaaacataatgtggtatcctagatgagatcctagaacagaaaaaggtatttaggtaaaaattaaggaaatctaaataaactatgaactttagttaataataatgtatgaaaattgaggtcaggagttcgcgagcggcctggccaacatggtgaaactgcatttctactaaaaaaaaataataaaaaaattagatgggcatggtggtgtgcgcctgtaatcccagctactagggagactcaggcaggagaattacttgaatctcggaggcggaggttgcagttagcccaagatcgcaccactacactccagcctgggcaagagagcaagactccgtctcaaaaaaaaaaaaattagccaggtgtggtggcaggcacctgtaatcccagctactcaggaggctgaggcaggagaatcgcttgaacccaggagacagaggttgcagtgagctgagattgtggcactgcactccagcctgggtgacagagaaagactccttctcaaaaacaaacaaaaacaaaaaattctagtaataaccattatttacttccaacttaaatctgatccacgacctaaaactgcactctgaaataatctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctccttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctatttaactatcagttatcgcactatgcttctacagttagtatctatgatgtgaaagttgaagccctggttaaagcttcttaaatctaccattttattttgtacaaacagaaaagtatattagttttctttccagctgtccttaatttttttaattgaagtgaagtttacataacatacaattaaccattttaaagtacattatgatttctctccagtttcaaactgtccttaagaatttttttatttttatttttaatttttttgaaacgggagtctcgctctgtcacccaggcttgagtgcagtggtaggatctcagctcactgcaacctccgcctccgaggttcaagtgattctcctgcctcagcctccagagtagctgggattataggtgcacgccaccacagccagctagtttttgtatttttagtaaagacggattttttcactatgttggccaggctggtttcgaactcctgatcctaggtgatctgcccgcctcaacctcccaaagtgctgggattacaggtgtaagccaccgtgtccagccaagaatttttaattaaagatgcactaatccaaatgtagatgagctactcaattttcagttaattaatcacatctgaagataatgatggcctatgccctcatatcaagtgtatcctgagcccttttatcattctaatctctttctacacgtggccaaccagagtgcatacatattgtgccaagtacctttcacctttttctacatatcagtagtattctatttcacagaaaactcacactcctgccctaaacataaccacagagttaggcttattgtgtggttagcctatctggcatgcctttgtctcacaaatgcttagaggacatttcacactacttagaaaggaatgatctcatcccactgacccaacagctaattttatcaaaaagctttttgttaaaagctgtgataacccaggaaaccagatctatttttacttttatggcaaggaaaaggaacagagaaaaccataaggaaaaaacagctcacacattgaccatttaaaaaaatcacttaggggcccagcacagtggctcatacctgtaatcccagcactttgggagcccaagacaggtgaattacttgaggtcaggagttcgagaccagcctggccaacatagtgaaaccccgtctctactaaaaatacaaaaaaagagctaagcattgtggcacacacctgtaatcccagctacttgggagtatgaggcatgagaatcgcttgaacctggagggggaggttgcagtgagctgagatcatgccaccacactccaccctgggcgacagagagagactctgtatccaaaaaataaaaaattttttttcacttaggccaggtgcagtggctcacacctgtaatcccagcactttgtgaggctgaggtgggaggattgcttgagtccaggagttcaagaccagcctaggcaacatactgagaccttgtctctacaaaatatacaaaaattagccaggcatggtggcacatgcctgtaatcccagctccttgggaggctgaggtgaaagatttgcttgagaccaggaggttgagtctacagtgagctgtgactgcaccactgcactccagcctgggagacagagagtgagacactgtcaaaaaaaataacttattctacagttttccccctttctttggtgtctgactacaagtgaacaaaaagaaaaactttcagaattgtttaatgcaagaaaaaaatcattattttaacaattaaaaagcaaacttcatattacagtccaaacactaaacctaccttgggtctgatttgtatgaaaaaaaaaaaaaaaaaaggatttctctccaataagaccccaagaaatatacaagtcttcagtgggagatgcaatataataaaatgacaaaatattaaaattgaagaagaaaaaggaaaaaaaaaaaagaaactccaacccatataaaaaaataagaactagaccagatgcagtggctgacacctgcaatcccagcactttgggaggccgatgagggaggactgcttcagcacaggtgttccagatcagcctgggaaacatagggagatcccgtctcaacaaaaaatttaaaaattagccaggcatggtggtatgtgcctgtggtcccagctactcaggaggctgaggtgggaggattgctggaacccaggaggttgaggctgcagtgagtcgtgatggcaccactgcactcactcaacagagtgagatcctgtctcaatagactaaaaataaaaataagaagagccagctgggcattgtggctcacacttgtaatcccagcactttgggaggccaaggcaggaggagcacatgaggtcaggagttcgagatcagcctggccaacatgatgaaaccccgcctctactaaaattacaaaaattagccaggtgtggtggcacacacctgtaatcccagctactcgggaggctgaggcatgagaattgcttgaacctgggtggtggaggttgcagtgagccgagatcccaccactgcattccagcctgggcgacagagcgagactccatccccccctctcaaaaaaaaacagcagttattgcagacttatattccagagaccattctaatcactttacataaattactttgcttaatatgttgaacaactctaggacatagataaccccatttaaaatgaggacaccagggcacttagaggttaaataacttgcctaagattgctcagctagtaaagtggcacaactcttaatttactaccaaatattgtctctcacagcaatctttatagcaagctctatgcaaagcaaaatgatcattcaacagactgaaaagtcaaaggctatgataatagcctttaacaattgaacactagtttaattgtttataacgctacctcccaccttttccacccacagccacccaatcccatccaggctgggtaaccagttagctcccttcaccaacaccactaccgacctgaccctcaaatgtaacacgtgaaactgccacacattaagcattcatctcctattaactttatgcctcctgttttttaattcttaaaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacacttaagaaacacaaaatagatcaagagcactgtttagagtgaatctccctaagtttatatgtatcaatcagtatgcatatgaaaaccaaatgagtgaaggcggctgatgtaaacaaaagagcctgcaacaggcaaacataagcaatgaaagctaatatagtatcttctggtgtgtagaccagctgtctgactttctaatggtgaatgttagcctacagtaagataaaacaaaagatgactataaggctgagagataaagactaaaatgaggttactggcttacagcctgaaaagtattctgaagccaaaaatcagatacagaatttggacccctatgaaatgcataaggctctccccaaatctcaactacacctccctaccctgtcattgattcttagtgggtcagaatacattcagtaagaatactagcatcaacatgaaataaaatctaaaaaggaaataaactctagtaaataaagttctgaggaaagtaaaaaagggtccctccaagaataggaaaagctgtcacaagaggtacagaacctccctttagctcttcatgtgctggattgatcctatatactcaaaagctgcatcagaatgagtaacatatgaataagagtggataagaatactaaatcaaaaatgatttatatcaattattgtccatcttcaatactaaaataattctttcacgcttaataattaaaatgctattcttcttctccaccttttcactttatttatttatgagacagggtctcattctgttactcaggctggcgtgcagtgacacaatcttggcttactgcagcctcgatctcctgaggctcaggtgatcctcccacctcagcctcccaagtagctggaactccaagcacatgccaccatgcctggctaatttttgtattttttgtagagacagggcttctccatgttgcccaggctggtctcaaactcctgggcccaagcgatcctgtcaccttggcctcccaaagtgctaggattacaggtgtgaaccacagcacccagcttcaatattttcagtacctacccctcaacctacctccatccctatgaaagtcgccatgacttcaggagcactctatatgatatgtacttctagtacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccactctgttgcccaggctggagtgcagtggcacgatcttggctcactgcaagctctgccttccaggttcatgccattctcccgcctcagcctcccaagcagcggggactacaggcgcctgccaccacgcccagctaattttttgtatttttagcagggacggggtttcaccgtgttagccaggatggtcttgagctcctgacctcgtgatccgcccgcctcggcctcccagagtgctgggattacaggcgtgagccactgtgcccggcctactgaaatcttctattccattatcttctagtgttgttttgcttttaagagttggctgtaggccaagggcgatggctcatgcctgtaatcccagcattttgggaggctgaggtaggcagatcacacgagcccaggagttcaagatcagcctgggcaacatggtgagatccagtctctacaaaaaatacaaaaattagccaggcatggtgatgcacgcctatagtcccacctatttgggagggctaagataggagaattacctaagcctggggaggtaaaggctgcagtgagccgagatcataccactgcactccagcctgggagacagagggaaactctgtctcaaaaaaaacaaacaaacaaaaacagcaacagaaaaaatagttggcagtgagtcataatttgaaaaatttcagtcctggtaaaaaccaatctcttaacagaaagaggtactattaaaactggttttcagttttccagtgctgacgatcccctcacgagaacaggcctctcacaaagaatctccctccctctccagaaaaaaagagcaagcacaagaagtgcctggtgcagagccccaattcttacttcctgaacgtgaaatgcccaggatgctataaaatcaccatggtcgtcagtcatgcacaatagtagttgtgtgtctggctgctctgctgtcctctgccagcctacaggaaggctctccttcagatagagacagcactgaaagaaccctgaatcaagatgagtgggaaactatatcaataaacacatatggatgccaaaaataaataaaagtagttttcaaactttaacgtggacatcccatggaaaggtggtttaaaagagattatgaagttctattcccagaatttgatttagtaaatctgggtaggagtccagaaatctgtattttaaagcagtccaaatggttctgatgcagatgataaaacaatccttatcagaaacatgcttacataatttaagatttaatctcaaaagtcatagcttgaactcttcttgcactaagttaaaggttaaacaaagtatctgcaagaggattctgtcctgctaacagactggtttttaatctgaacattgtttggctcaacagtcctttcatagacttcctctaaagcaacttggtaagccactaaaatctaactgttcctcttaactacagccctttgcaccaagaaaacagaagaatgatataaatgaaaggcatttctgttgcccagtcattggctctataactgaaagggcttttgaaaaccagtcacattgactatacaagtgacatatgcagtcatcagtttggaatctctaaggactacagctcaaaaacaatcactaacagctcaaagtctgaccccaaagtgcttaaaagccattgatgaaataaagccttcataagaacattctacaatccacgcttctactccttgctattacaagccaataggatcttaaggttttaaatttgacaaaatcatattatttatttttatttttttatttttttttgagacggcatcttgctctgtcccccaggctagagttcagtggcgtgatctcggctcactgcaagctccgcctcctgggttcaggccattctcctgcctcagcctcccgagtagctgagactacaggcgcctgcagccatgcccaactaatttttttttattgttagtagagatggggtttcaccatgttagccaggacggtctcgatctcctgaccttgtgatccgcccgcctcggcctcccaaagtgctgggattacaggcgtgagccaccgcgcccagcctatttatttattttgtaagacagagtctcactgtcacccagctggagtgcagtgccgcaacctcggctcactgcagcctctgcctcccaggttcaagcaattctcctgcctcagcctcctgagtagctgggactataggcatgcgccaccacacccagctaatttttgtatttttagtagagacggggtttcaccaattggtcaggctggtcttgaactgctgaccttatgatctgcccgcctcagcctcccaaagtgctgggattaaaggcgtgcgtgcgccaccacatccagccaatttttgtatttttgatagagacggggttttgccgttgttagccaggctggtcttgaacccctgacctcaggtatctgcaagccttggcctcccaaagtgctgggattacaggtataagccaccatgcccagccaataaaattgtattttaaatgcaccaagtacctgcgtcaacaatccaaaaatgatattaagaaaacaattctgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctcccaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaaccccatctcagtctgggtgatgcggtgcgaccctgtgtccaaaaaaatacatgaaaatcacaccaagcttctttgtagaaattgacaatcaatcctaaaattcatatggaaattcaagggacccagaatagctaaaacaaccctgaaataaaaacaaggttgacggacacatactttccactttcataacatactacagaaagctataatagtcaagacaatgtggtactagtataagcacagacaaagtcctgggagggtagcacacccgaattccaccaggagagatgctcctgctctcaggacctttccagaccttgtcttatatatctcttcagctggctatttatgtgtatcctttaaaatatcctttgtaataaactggtaaacatgtgttttcgagttgtgcgagctgctctagcaagttaagcccatggctataaatgggaacaccaatttatagccagtcagtcagaagcacaggtaaaataagcgggagcttacaactggcatgtgaagtgtggggagaggcagtcttggaaactgagccctcaacctgtggaatcttgatgctatctccaggttgattatgtcagaattgagtggctgtcagctgcagaaatgactgcttgcttgcctgctggtggggagaaatccccacacatctgctttcagtagggtgctataagaatatcagcagtaggagaaacggagtttgttttttccacacacacctgtatctaaaataccaaaaactctggcaacttaataataaaaaggcaaattaatttaaaaatgaacaaagaatctgtacatttctccaaagataatatacaaatggccaataaacacattagtcaccagaaaaatgaaagtcaaaaccacaatgagatcctacacccagtagcatgactaaaataaaaaaaaacaggtaatgaatggcaagtgttttagatgtggcaagaactggaaccctcatatactgctaatgagaacataaaatggtgcagccaccttgaaaaagtctgggagctcctcaaaagattaaacagagttaccatatgaaagcagaaataacccaaatgttcctcaacaaataaatgataaataaaatgaggtacatacatacaatggaatattattcagccataaaagggaataaagtcctaatacatgctacaagatgggtgaaccctgaaaacatcacaaaagaccacctactatattaatctgtgtatataaaatatccagagtaggtaaatttatacagaaagtagattcatggttgcctggggcttggggtttattgtattagggagtgataaagaacatgggatttcttttgggggtcatgaaaatgttctagactttactgcactaatggtgcacatgtctgtgaatataccaaaaaacaatgaattgtacattttatttatttatttattttttgtgatggagtcttgctctgtcacccaggctggagtacaatggcatgatcttggctcactgcaacctccgcctcctgagttcaagcgattcttgtgcctcagcctcccaagtagccgggattacaggcacgtgtcgccatgcccggctaatttttgtatgtttagtagagacggggttttgccatgttggtcaggctggtctcgaactcctggcctcaagtgatctacctgcctcggccttccaaagtgctgtgattacaggcatgagccactgtgcctggcctgaattctacactttaagtgggtgaatggtatggtatataaaatatatctcaacaaaactgttaccaaaaagagagataacaccaaacacatgaaacttccttcctatgagattattcttaatactagctttaaggatatttcctttttgcattacttttagaatattttctacaaatattattttcagtcagtccaagttttttaaaagcaaaacttgtcaaaggaaacatactttgttagagatgcatatacaaactctgcaaagaaaaggctagttagggggtacccctaaaaactaagaagaaaaattaaactttccacagtttacaaacaggcagctttcattttacacaatagtgcaaaaccgtaaaagtaagaatgcacgctgaaaccatgcaaagtgatcataataattaatgagaaaaactgcaattgctctgtaatctttttttttttaaaattgagacggagtctcgctctgtgtccagtctagggtgcagtggcgcgaccttggctcactgcaatctccacttcctggggtcaagcgattctcctgcctcagcctcctgagtagctgggactacaggcacgtgccaccacacccagctaatgtttgtatttttagtagagatggggtttcaccatgttggccaggatggtctcgatctcctgacctcgtgatctgcccacctaagcctcccaaagtgctgggagtacaggcgtgagccactgcacccagccgctctgtaatttttttttgtttttgttttttgagacagtctcactctgttgcccaggctggagtgcagtggcgcaatctcggttcactgtaagctccacctcccaggttcatgccattctcctgcctcagcctcccgagtagctgggactacaggcacccgccaccacgcccggctaatttttttgtatttttagtagagacggggtttcaccatgttagccaggatggtctcgatctcctgacctcgtgatccacccgcatcagcctcccaaagtgctgggattacaggcgtaagccacagtgcccggccgccactctgtaatttttaaaaaattttgggccaggcacagtggctcatgcctgtaatcccagcactgggaggccgaggtgggcagatcacttgaggtcaggagttcgagaccaccctggccaacatggcgaaacctcatgtctactaaaaatacaaaaattagccaggggtagtggcacacgcctgtaatcccagctacttgggaggctgaggcaggagaattgtttgaacctaggacgggttcactacagaggttgcgtgagctgagactgcaccactgtactccagcctaagtgacacagtgagactccatctcaaaaaataatttaaaaaataaaataaatattacccaggggtggtggtgagcacctgtaatcccagctactcgggaggctgaggcaggagaattgcttgaatccaggaggtagaggttgcagtgagccgagatcacactactgcactccagcctgggcaacagagcaagatcctatctcaaaaaaaagaattttttttttgttgaggccaggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctctgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaaactgtcttccactaaatcagtgctaaaaaggttgaggaccactgcactagagaacatagaaatattgaaaattataatgtttaagttctttgaaaaaatttattaggggtagtttaaatagtgcttacattcttctcatcatacaatagagacggggtttcaccctgttagccaggatggtctcgatctcctgaccttgtgatccgcctgcctcggcctcccaaagtgctgggattacaggcgtaagccaccgcgcccggctgcaatagacatcttttctatgccttagccaattgtcacactcctgtctgagtctggaatagcatcaaatactttatgtttcatatttcaatatcacagaataccttcgagagttctttcactacaaaatttcttgcatcacttcttttttttttttttttttttaccaaaccactttcttcacttatgtagataagctcaccttcactaagttatttcggctacatatccagagtgttttgaatgagagcatcagcattccctcagtgatctatttcttctataactccatttgagttcaatttgaatttcacttccactgttgttactttttggttttttcctgaactttcatctttttcggccaattctctctatcggttatcgatttttcttaactatcacatagatttatcactgggagacaaggaggtaacacaaacccatgctttgcacagttgttacttatgtagtgacagaagagctggcagcgaattttgtactttatacgattattcacagttaatatgctgtgtaaaatttaaaccatgttattagggaattggtattatttaaccaaaccatggtaagtgaaagtgtatatgagaaccacataaagcaacaactccctgtatatcacatcacaaaatcacagaacttaaaagccttcttcacagtaatctagccacagtgtgtatgtggacccttgatgtagtattaatgacccgtctacttcctgcctgaccatttcaagtgatgcccacattacttcacagggtggctctttcattgttgaacacttctaacagttagaaaaataaagcccccagctagtataatggtcaaaagcacaggttctaaaatcagaccacctgaattcctatcctttcttttcctctgttgagctaggtaaatttgggcaaggtatgtaatctctccatgactgtttactcatctataaaataaaaatgttagccgggcgcggtggctcacgcctgtaatcccagcactttgggaggctgaggcgggtggatcacgaggtcaggagatcgagaccatcctggttaacacggttaaaccccgtctctactaaaaatacaaaaaatgagccgggcgtggtggcaggcgcctgtagtcccagctactcgggaggctgaggcaggagaatggcgtgaacccaggaggcggagcttgcagtaagccgagaccacaccactgcactccagcctgggcaacagagtgagactccgtctcaaaaataaataaataaataaataaataaataaataaataaaaatgttaaggccttcaatcatgaagttgttatgagggatggcaagtgttcagtaaattataacctatataatttatcatattatcatcatcgtctgtagagtgcttagtcttccttatccatccccatgtactttggttcaaacccctcacctagattctgcactagactcaactgaacactgacagtctctcacccagttctccatatggtcaccagaattatctctctaaaaataaaatctgactccggtcagcataaacaatttagcctaaagccatcaggtagggtagagcaagcagagcaaaatcagagtcttcgtttaggggtggggaggaagccatggtggctgaaagcagggtatcaaataccaagcaaagtggggagggaattcatgtggtaaggtggcctggcccaacataacttataaggagtcaaaagacggctactattttaaaaagatgacatgaaacctacaaattgaggaaacacaatagtccaagagggaaagaaaacccaacatctgtcaagtagacacaattacttactttaactccatgttttcttgtttccttgtaaacacatgggtgttttggtgttcgttcattttgttattttcttagcactggttttcacaaaattcactttcggaataaaatttcatttggaatgatgtctctcttgaatttgtcaacaaaaggaaactcctagtgatgcctcatcatcagctacacaaatatttggtatttgaaaaaatgctggttctttaaaaaacacatttgtggttctctatcacttaaaaaataaagagacagagagagatgtttggcacagtgacacacagcctatagttccatctacttggaaggctgagacagaaaggattgcttgagtccaggagttcaaggctgcaatgagctatgattatgcctgtgaacagccactgtactgggcaatgtatctagactcccatcttttaaaaagagagagagaaagagaaagtacaaaagagaaaagaaaatgacaagaacaaagaaaaaagcagacaatattaactgtgaatctaaaataggttgtagagctcctcctgatgctgtaacctgatcatggtgcacactgataagctcccattacaacataagaaagccacagacaatggagcaagtcatcaccttccttgtattacaatctcatgtccttgctttggatgctgtgcctcctaaccacacctagtaaaagtagcatcacttatttggcaacatctagtatttaagaaccaagtaaaggcctgaaaggaattaccaggcaagactggatggtactgtgcaaggaacacacactttatcatcaggtagatccagatctcaattatcttttttttttttttttttttttttttttgagacaaagtcttcactctgtcactcaggctagagtgcagtggcagcgccaaggctcactgcatcctcaacctccaggactcaagtgatctcccacctcagcctccagagtagctgagaccacaggtgcatgccgccacactgggctaattttttaaatttttttgtagagacaggatctcactatgttgcccaggctggtctcaaacattatgacactgatacataactgttaactagactacagaccttattcagttttcactattttttttaacctgcatttgtgtgtgtatttctaagcagttttgtctcatgtatagatttttataaccacaactgcaatcaagatacagaactgttctgctacctctctgtatttatagcccctccacctactacccccctgtcccctggcaatcactaatctattcttcatctttacagttttgtcactttgagaatgtcatataaatggaactatataatatgtgacctcttgagataagcttttccactaagcacattacccttgtagtctattcaaggtgttgcaggttatctatagcttgcttgttccttttgattactcagtagtattccatgctatggatgtcatatgttttgctttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtctctactaaaaacacacacacaaaaaaatagctgggcatggtggcgcgtgcctgtagtcccagctactcgggaggctgaggtagtagaattgcttgaacccaggaggtggaggttgcagtgagccgagatcgcaccactgcactccagcttgggcaacagagtgagacttcgtctgggaaaaaaaataaattaattaaattaaattaaaaatttttggccgggtgcagtggcccatacctgtaatcccagcaatttgggaggccaaggcgggtggatcaccggaggtcaagagtttgagaccagcctggccaacatggtgaaaccccgtctctactaaaaatacaaaaagtagctgggcgtggtggcacacacctgtaatcccagctactcgggaggttgaggcaggagaatcgcttgaacccgggagccagagattgaagtgagccgagatgacactactgcactccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttctcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgcggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccagagtttcttaacaccttcactactgaaattttggacaagaaaattgttatgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctaggagttgtgagtgcagggaaatggaaggattaggtggaagagtagctaaggagaacagggtgggtttttttgtttttgttttttgagacagagtctcgctctgtcgcccaggctggagtgcggtggcgcgatcttggctcactgcaacctccacgtcctggttcaagctattctcgtgcctcagcctcccgagtagctgggattataggcgtgcactatcacacccagctaactttttgtattcttaggaaagacagggtttcgctatatcggtcgggctggtcttgaactcctggcctcaagtgatctacccgcctcagcatcccaaagtgctgggattactggtgtgagccaccgcgtcctgcctgagtaatgaaaatgttctaaaactgattgtggtaatggatgcacaactgtgaaaatactgaaaaccactgaactgtacattttaagtggctgaactgtatgttttataaattgtatctcaatagagctattctttttaaaattcagattctggactccactccagatctcataaattagaatcaaaagcagaaagccaaaactattctaaaataccttccaggatcactaggaggacatttggggttcacagccagacagtgatgaacatctcaaaccacaagatgcacagaacggctaagaggaaaatgagcttgctgtgcactacccaatggttaactgcttggaaaaatatggaaactgataacgtgttaaatatgttcaataacacatctcaaatttatgtctaagaacacatttcaatttcaactccatgttaagttgaaaggatagcttcccaaattatgacatatgtaccttcacctttaaagaaacagaaactaaaacaactccaaatattatatgcttttacatctacattcattcattaagtggttttataattactggttttgagttatactgcagctactcacatcataagaaaaagacaacataaagtacaagaataaacttgagtataatttttaattagacctgatgcatcaatctgaatagctaataccaaaaatcctaagctatgaaatctaaatttcccaataaatctgaacatctgcaagtataccacatagcaattagaaaaaactgtactatggaaaagatttaagtcgttctggtttctgttttgcaagttccagcagaaaactaatgctagggttcattgaaacaacactgctagtatctcctatttcctccaagaacaaacaagaaagccattattatctcaaatgttcttctgaaaagtataatgacccttcttataatattatggaaaatatgaacaagaattttaatcaaaatagcattcgtaaagccacatgaacacttttattttttttatttttaaactttaaaatctaaatacctacccaaatacccagtgtttctaaaactaatgactaaatctgatttacttctaactctctctagtatataagtgatgtctgaactatgagattcatgtgaaaatgtacgtcgtttatttgtacatgatctgtctctcaggcactcgacctaggggagtaacacatattgatgatctccagaatgtgcacattacaacctgattgataccaaattggtgctatattcatgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaagagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtgggtggatcatgaggtcagaagttcaagaccagcctggccaacatagtgaaaccccgtctctaccaaaaatacaataaagtagctaggattacaggtgtggtggcgggcgcctgtaatcctagctactcaggaggctgaggcaggagaatcacttgaactcgagaggcagaggttgcagtgagccgagatcatgccactgcacgccaacctgggcgacagtgtaagactccatctcaaaaaaaaaaaaaaaaaaaaaaaaaaaaattagctggccatggtggcgggctcctgtaatcccagctactcaggaggctgagacacgagaatcacttgaaacctgaaagcagaggttgcagtgagccaagatcataccactgcactccagcctgggcgacaaagcaagactctgtctccaaaaaaaaaaaagaaaagaaaagccccaacaaaagtcagtcttctttagctaaaagaccaagaaagtagcagtctagcaagacagaaaagttttagacaataaccaatctaccccagccaaacaccaagaaaatactgtggtttaaaacctacccgttctagcaaaggccaagtggggagcctagatttccaacctctcaaagctgtaattaagcactcaataccccttccaaggtggagacagaaagccaagtagggtatccaggaatttcatccctgcagaccagtaacaagatcagcggggaccacgtggggaacctgggcctccaccatattatatcaatacaaatggcagtttctttaaaaagtctccctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcgtctccgcccggcagccaccccgtccgggagggaggtgggggggggtcagccccccgcccggccagccgccccatccgggagggaggtggggggtcagcccccccgccccgccagccatgccgtccgggagggaggtgggggggtcagccccccgcctggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtgggggggtcagccccccgcctggccagccgccccgtccgggagggaggtggggggggtcagccctccccccggccagccgccccgtctgggaggtgaggggcgcctctgcccggccgcccctactgggaagtgaggagcccctcagccccgccagccgccccatccgggagggaggtgggggggtcagccccccgcccggccagccgccctgtctgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgacccgtccgggagggaggtggggggggggtcagcccccctgcccggccagccaccccgtccgggaggtgaggggcgcctctgcccggccagccgccccgtccgggagggaggtggggggttcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggaggtgtgcccactagctcattgagaacgggccaggatgacaatggcggctttgtggaatagaaaggcgggaaaggtggggaaaagattgagagatcggatggttgccgtgtctgtgtggaaggaagtagacatgggagacttttcattttgttctgcactaagaaaaattcctctgccttgggatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaataaataaataaataaaaaagaaaaaaaagaaaaaaaaaaaaaagtaagcatgcgactaccatatggcctagcaactgtactcctaggcaaactgccgaactatttttcagagtggctgtaccactttactgttaactgtttcaatgtcaataccctggttgtgatattgtaccatgattctgcaagaaatttccaccaggggaaactgggtaaagtgtacaagggatatctctgtattattgtttcttacaattgaatgtaaatctataattatctcaaaattattttaaaaaactgtgtttaaaaactaaattaaaaaacacaaatatactaaatatttagacttaaggctgaactatgagttacatatccttatatcccaagcacctacaccaaagcctagaacatattagacaataaatatttattgaattagattgaacatacaatcagcacttcaaaaatataagatgcttacaaacctaacagttccatttcgttggctgtaaataaagtaacaataccttaaaacaagtgcaaaaaagttaccttcaagaaaatataaagtattctggaattttttcaaagagaaaaatgactcagtcctagactacaatgacttagatattacctcattattttggctaatttattgtacggagagagggagggaggccagtaggccggctggccagcctgcgaggcttaaaaagtaccatgtacataatttaaaaattagcatatagtagggagtctttagaaaccaagtagcacacataaatactacacatacccacccacttgcaaaggtgttttaagccaaaaatcttactctacgtgtccaagtttcatcggtatttctgattttcactaggtctggctgaacaggattatgtcttatcttttagagtaactatcagaactggtgattatctccatcatctatgaacacagtccttttcatctgataaaactggcattcggtaacaagaaagcatcttattttaccagaatgacccaagtaattcattaattaaagaaaaaaatgtatacaggaatctttattgttgctttggtttgttggttttctaaaaccaataaaacaattgtcttttcctgcataaacacctgatttgaaaatctagatacaatattattttattttattttatttatttttgagatgaggtcttgctctgtcgcccaggctggagtgcaatggcactatctcggctcactgcaacctccacctcctgggttcaagtgattctccctgcctcagcctccgagtagctgagattacaggcgtgcaccaccacgcccggctaatttttgtatttttagtagagatgggtttcatcatgtgggccaggctgctcttgaactcctgacctcaggtgatctgccctccttggcctcccaaagtgctgagattacaggtgtgagccaccgtgcccggcattacaacattattttaaacagccttcatcattaagtaatgaaagtgaaagtagagtcagcagtcagtaaaaacactttgtgattgaataattcaagtacagaattaacagccaaaactacatgaactgaacagataatgataaaaacccaatcagggccaggcacagtggctcacaccttaatcccaacactttgggaggccaaggtggggagattgcctgagctcagtggttcgagaccaccctgggcaacatggtgaaaccccgtttctactaaaatacaaaaaattagccaggcatggtggcgtgcgcctgtagtcccagctacctgggaggctgaggcatgagaatcacttgagcctgggaggtggaggttacagtgagccgagatcgtgccactgcactccagcttgggcaacagagcaagactccatctcaaaaaaaaaaaaaaaaaaaaaaaaaagacctactcaggatagcaacattacaataatggcaagccatacttattttgatcctttatggtccatatgaacacatgaaatcttaattatttgagaattcaacaacttttgggctgggtgcagtggctcacacctgtaatcctagcattttgggaggctgaagcgggtggctcacgcctgtaatcctagcactttgggatgctgaggcaggcggattgcctgagctcgggagttcgagaccaccctgggggcaacatggtgaaaccccatctctactaaaatacaaaaaattagccggcttggtggtacacacctgtaatcccagcaactcaggaggctgaggcaggagaattgcttgaacctggaggatgcagtgggctgagattgtgccactgcactctggcctgggccacagagtgagactctgtctcaaaaaaaaaaaaaaacttttgaacatctctctcttaaacctctggcctttaaaatcccaatcatatcacatttaatatacatgggttattaaatgggttcaggaattgttagtctgcagtagaactctgcaacaaacaataaacagtttcatcaccaaaaggtacctggatgtaatctcaattagtaaaaactcagtcactcatatgtcactgacatatttcctttggacaaggcaactcattctgttgatctttctcagccactatgaagtttatcactcatgcctgtaaatggtacatggtcatgaactgctacagaataaagtccaagagaacccaccaaaactgtggaagattaaaagattgatggatcattaaaaaaaaatggattatagacctaaatgtaagatacgaaactataaaactcctagaggataacatagaagaaaatctaggtgacctagggtttggcaatgacttcttagatacaaccccaaaaacatgatgtaggaaagaaaaaactgataagctggactttactgaagttaaaaattctgatctgcaaaatacactgctaagagaatagaaactcaacagattgggagaaaatatttgcaaaacacatctctgacaaagaactggtatccaaaatatacagaggccaggcgcagtggctcacgcctataatcccagcactttgggaggccgagggagatggatcacaggagcccaggagttcaagaccagcctgggcaacgtgtcgaaaccctgtctctacaaaaaaaaaaataataataatacaaaaaaaatgtagccagtcttacaacccaatctcaaaataaataaaaaattaaaaacgaaacaaaatatacaaataactttttttatttttgagacggagtctcactgtcgcccaggctggaggacagtggtgcgatctcggctcactgcaagctccgtctcccaagtacacgccattctcctgcctcagcctcccaagtagctgggactacaggtacccgccaccacgcccggctaatttttttgtatttttagtagagatggggttttaccacattagccaggatggtttcaatctcctgacctcgtaatccacccacctcggccttccaaagtgctgggattacaggcgtgagccaccgcgcctggacccaaagagctcttaaaatttaatatgaaaatgaacacctccccctccccctccccctctccctctccctctctttccacggtctccctctgatgccgagccgaagctggactgtactgctgccatctctgctcactgcaacctccctgcctgattctcctccctcagcctgccgagtgcctgcgattgcaggcacgcgccgccacgcctgaccggttttcgtatttttttggtggagacggggtttcgcctgttggccgggctggtctccagctcctaactgcgagtgatctgccagcctaggcctcctgaggtgccgggattgcagatggagtctcgttcactcagtgctcaatgttgcccaggctggagtgcagtggcgtgatctcagctagctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcccggcagccgccccgtctgggaagtgaggagcgtctccacccggcagccgcccagtccgggaggtggggggcagcccccgcccggccagccgccccgtccgggagggaggtggggggcagcccccacccggccagccgccccatccgggagggaggtggggggcagcccccgcccggccagccaccccgtccgggaggtggggggcgcctccgcccggccgccaccccgtccgggaggtggggggcacctctgcccagccgccccttctgggaagtgaggagcccctctgcctgaccgccaccccgtctgggaggtgtacccaacagctcactgggaacgggccatgatgaggatggcggttttgtcgagtagaaaggggggaaatgtggggagaagatggagaaatcagattgttgctgtgtctgtgtggagagaagtgggcataggagactccattttgttctgtactaagaaaaattcttctgccttgggatgctgttgatctatgaccttacccccaacccggtgctctctgaaacatgtgctgtgtccactcagggttaaatggattaagggcggagcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccttctgcgagaaacacccaagaatgatcaataaaaaaaaaaaaaaaaaaaaaaacatcactatgtaccccatgactatgtacaattgttatctgtcaattaaaaataaaataatgtttaaaaaataaaaaaatttaaaaaattaaaaataaattaaaaaaaagaaaatgaacaatgtggctgggcgtggtggttcacgcctgtaatcccagcactttgggaggctgaggcgggcagatcacctgaggttgggagttcgagaccagcctgaccaacatgaagaaaccccatctctactaaaaatacaaaaaattagccaggcgtggtggcacatgcctgtaatcccagctactcgggaggctgaggaaggagaatcacttgaacctgggaggcgggaggttgttgtgagccaagatcgtgccattgcactccagcctaggcaacaagagtgaaactctgtctcaaaaaaaaaaaaaagaaagaaaatgaacaaccccattttaaaaataggcaaaagatctgaacagacacttcaccaacgatatacgaatggcaaataagcatatgaacgaaaagatgttcaataacatatgtcatcagagaattgccaattaagacaacaataattctgacaaccgtggttaaaagaaattattaataagaaaaaaagacttcaaattcattaaaaaaaaaaaagacaacaatgagatgccaccgtgtccgtatcagaatggccaaaatccaaagcacaacaccaagtgctgacaaggatgtcaaacaataggaaatctcattcattgctagtggaaatgcaaaatggtacagccagcaaggtgagctggaatcacctatagtcccagctactcaggacgctaagccaagaggattgcttgagcccaggagatgagtctagcctgaacaacatagcgagacctgtgtcttaaaaaaaaaaaaaaaaagttatacccagtttgggaggttcttacaatactaaacatactctctcaccacacaatccagcaattgcactccttgatatttacccaaagatgaaaactcatgtcaacacaaaaacctacatgtggacatttatagtagctttattcacaattgccaaaacttggaaccaactaggatgcctttaataggtgaatggataagcaaattgtagtgtacccagacaatggaatactattcagcaataaaaagaaatgagccatcaagccacaaaaagacattgagaaacctcaaatgcatattgctaggtgaaaaaaaagccaatctgaaaggctatatactgtataattctaactatacgacattgtgaaaaaggcaaaactatgaagacagaaagatattagtggttacagtagttaaggggaagaagtagggataaataggtggagtacaggggatttttagggcagtgaaactattccatatacatattattatgaaaccatctttgcaaaaattataactgagacaattattacagtgaaagagatctgatctaaccaactccatcctgcttctaacctcccagctgtccttgttcattcctagacttagcccaaactaactttgtttgggaggaacttagtttacagtttaggttagttttcccagaacaaacccccttcctggctggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaattatcctttaaaactccaattcacaaattctcggacagactgatttaagtaataataaaactctggtctcccacacagtcagttctgcttgaattactctttctctactgtaattcccatcttgataaataggttctgttgagccagcgggcaaggtgaccccgttgggtggttacaattagacagtcatgcatcacttaacaatgggaatacattctaagaaatgtgttaggtgacttcatcattgtgcaactgtcatagagtgtactaaacaaacctagatggtacagcctgctacacatctaggctatatggtataatctgttgctcctaggctacaaacctgtacagcatgtaactactgaatactgcaggcagttgtaacacaatggtaagcatctgtgtatctaaacatatctaaaaacagaaaaactaaggtgttatgccaagcattacatcactaggcaatgaaaaattttcagctccactatatagaaagtacccatctctacaaaaaaagaaaaaaaattgccagccttggtagtgtgcacgtgtagtcccatctactgtggaggctgaggcaggaggactgcttgaacccagaagttccaggctgcagtgagttatgatcgtgccactgcactccaacttgggtaacaaagcaagacactgtctcttaaaaaaaagaaaagtctattaattttaaaaaagaacctctgcacaatggaatgatcttcattctttatatactactgtaccacctcataaccatgactaacattactaataccactcacatctcaaacatagcaatctaactccttacaacttaaagtgtcatctgtagaccaacaggattagcatcaccttatagatcagaaatgcaaaatcttgggtcccacactaaaccttcagaatcagaatctgccttataaaaagatcatgtgatttgtatgcacactaaaatctatgaaggcctaatccaaagctttcaattcaaaggccacacaaggcaagggggacagaaatcaaggccctgggccctcccaaagttaagccttataagacaccccaccatatacctctccaatctaaaccaagccccaaatttttcactatccctagcggactatatagaagcctgccttggtgttgagcaaatcaaaagaataaaaaattcctgagaaatcatagccacgaggaatccctgtatgcactggcatcttagtttcttataatctggataagccaatgactgtcaagtcatgcagtttgaggaaataaaaaactagtgatgccacagagtacctgacagatattaacaccaaggctaacttctcaagcaacaatgtaagccagaagataatggaatgataagttcaaggctggacagggtggctcacacctgtaattccagcactttggaaggctgaggtgggaggattgcttgagtccaggagtttgagacaagcatgggcaacatagtaagaccccatctctacaaaaacaacaaaaaaagaaacgataaattcaataaactgaaagaaaataaaatgcaatactaataaacatacaaacaaacatacaatactatgccccccaaaaaagtagttttcaaggatgaaagaaaatatatacctatatagtatatccgtagaagttttctggggacagggtctttgctgttggttagattctcaaggggatatatactcatgaaattaagaaccatttatttacaaaaacattaaaggtcattcaacttaacttcctccccagtatctctaaataccctggctctgttttaacataagttaaactcagtatcttactttaacatgaggaaactcactatcttataagaaagttacattccatttttctctttaacttctacttgatggtccttgttcttttgtcaaagcaacaaaatactaaatctaatgcctattccacttgccagatctttgatatatagttagccctccaaagccacaggttccacatccttggattcagccatcacatatatatattttttattttattttattttttgagacacagtttcactctgcctcccaggctggagtgcagaggcgcaatctccgctcactgcaacctctgctacccgggttcaagtgattctcgtgcctgaacctcctaagtagctgggattacaggcgtgcgccaagtatatcgcaggacatgcagaggtacatcattttatatatgggaccttatcatcctcagattttcttatctgcaggaggtctgagaaccaatctcccatgaataccgagggacaactgtatttgaaaatagctgtccccacctctttattctctaaatgaaacatctctaattccttttttttttttttttttttttttttttttttttttgagacggagtctcgctctgtcgcccaggctggagagcagtggtacgatctcggctcactgcaagctccgcctcccaggttcacaccattctcctgcctcagcctcctgagcagctgggaccacaagcgcccatcaccacgcccggctaattttttgtattttcagtagagatggggtttcaccatgctagccaggatggtctcgatcttctgacctggtaatccgcccaccttagcctcccaaagtgctgagatcacaagcgtgagccaccgcgcccagcctctaattccttaaataatgtctcaaatcattttaattactccatcaccagacagactgttttctcctggaaagactctatccatgctccgaaaatgtgcctcttaaaactgaacactctcattttacagtagaggggaaaaaaaaacctcaacacaatactaaaggtctggaatattatgttcccctgtattttcatttatatttttaaattttttttggcgtgattgcgccaagctggattgcagtggtgcaatcatggcttactgcagcctctatctgctgggctcatgtaattctaccacctgagcctcccagagtagctaggactacaggcacaagccacagtgcacagctaatttttacatgttttgtagagacaggggtttcactttcttaggtttaaaaatatagaggcggtctgggcatttatgcttctgactacctgaataataccacctccccgttactgtctcaaagttaacaagagaaaccttttttttttttttttttaaatccccagacagagtctcactctgccacccaggctggagtgcggtggcacaatctcggctcactgcaacctctgcttcctgggttcaagcgattctcctgccttagcctcccgagtagctgggattataggcatgcaccaccatggccggctgatttctgtatttttagtagagatggggttttgccctgttggcaaggctggttttgaactcctggcctcaagcaatccacctgccttggcctcccaaagtgctgggattacaggcgtgagccactgcaactggcccagagaagcatttttttaaaaactattttaaataatatttaaggaccaggtgtgatggctcatacctgtaatcccagcactttgggaggctgaggtaggcagatcacttgagctcaggagttcaagactagcctggacaacatggtgaaaccccatctatacaaaaaatacaaaaattagccaggcatggtgccacacacctgtaatcccagctactcaggaggctgaggtgggaagatcatttgagcccaggaggcagaggctgcaatgagccaagatcgtgccactgcactccaacctgggtaacagagcaagattctgtctcaaaaaaaaaaaaaaaaaaaggaatatttaagtaataaacatccagctctactaattaaaaactaatgaaaattaactgaatccttggctgtgagtcaattcaacaaagcaccatgatctccttaaggcatttattttatttatttatattttagaggtaggatctcactatgttgtccaggttgtacttgaactccaaggctcaagtgattctcccgcctctgcttctcaagaagctgggactggccaggtgtggtggctcacgcctgtaatcccagcccttagggaggccaaggcgggcggatcacgaggagttccagaccagcccggccaacacggtgaaatcccatctctactaaaaatacaaaaaattagccaggtgtggtggcaggcgcctgtaatcccagctactcggaaggcagaggcaggagaatcgcttgaacccaggaagtggaggttgcagtgagccaagatcgcaccactgcactccagcctgggcaacagagcgtccgtctcaaagaagctgggactatgggtacagttcaccatgccaggctcctaagacattcatttaaatccacttagtcattcatacctatgcacaatatgtatagcatttacagtgtgtatcatgacacttttaataataaagtcagtgttttaaagtcagtgtgtattgtttcttctattttactttttaaaaaatcacctacagcacttaccacagtgtatgcacctagaaggtatataaatatccgtggtattaaattgaacacagtagaaagaatgctagagattaaagttcaaattctgactcagctacaacttagtaaatgaccttaggagaaggcagaattattctgggactcaaagtggttccagtaagtccatgagtttcatatttcacagccaatttgccatctatataacccaatgaaacttacagggaatgtaatttccattgaaaacatcaatgcttcaccaattccatatacacaaaaattattttctgatttgtatcactagacagtgtcttactagcattctgaaggtcacccatcccagtcacgaagcccttaattctcacaaccttgattttataaataaggaaacagatagactgatctgccccagacctcacagttattatgtggtacagatgaaacctgaaccttggtcttttgacactcagtccagtgctattactgccatactatagttgcctgtcactgataattgcaaagtttgttaatttgggcaagtctaccttagacttttagacaacacactgttgaaaggcaccccacctctggctgatgaaataggctgactggtttgcctctgaagcatctcagcaagtctcagctatactgagcacacaaagttattcagaatatctttcaaacatttttttgtccctattattgttatcttattttagcttgataaagaacaactgtctgggtagccactgacactcttaaaatatactcagcccaagagaacttgctaaaatggaacatactaaattggttgagtactaaagcaactggctatatcagagaacctcattatcggtgacccaaacttacctttaattatcagatatatgaccatgcaatactgatgttattgttttaagaaaatcagatgtgattaaaagtgtgagattatccctttttttaacctattaaactagcaatattagtgaaaaaaaattttttttctgagacagggtctcactccattacccaggctagaatgtagtggcacgatcatagctcactgtaacctcaaactcctgggctcaagtaagcctcctgccttagcctgctgagtagctgggactacagacaccaccatggctagataattttttttaactttttttttttcagagatggggtcttgctatgttggccaggatagtctcttttttctttttttttctccctcctcaggtgctacttaaccaggcttgttttgaactcctggcctcaagtgatcctcccacctcagcctcccaaagtgctgggattacaagtgtgagccaccatgcccaaccacggtttctttttatccttcttcttcttcacagagacctcttcttctaccactactacttttccttcttctccatcttcttcaattttaattttactcttggccttttttgctttctttgtggtaatttcatcttctttatctgttctgagttttttttaattttttactttttgtacaaatggggtctcactatgctgcttaggctggtcttgaactcctggcctcaagcaatcctcccatccttggtatccgaagtgctgggattccaggtgtaaaccactgtacctggccctattttgtgtttttgtagaacaggttggaagtgtggacccaccaatacattcttttaaaaaaatttttagtattttcttattaaaagggaactgtgggccaggtgtggtggctcacacctgtaatcccagcactttgggaggcagagacaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaagtacagtgtgcttttaaaaagcatttctccatgtctcgtaataaagggcagacaaaaatataacaaacaaatgggtcagatactgccctttaactgcaaatggtttgttacccccatgtctctgtaacttagtgaataagagggaaaggaaaataagtaagcttgagtttactcaagaagaaatctgagggccaggcacggtggctcacagctgtaatcccagaactctgggaggccaagatgggcagatcgctcgagctcaggagttcgagaccagcctgggcaacatagtgaaaccctgtctctacaaaaaaaataccaaaaaaaatcagccaggtgtggtggcacacgcctgcagtcccagatacccataaggctgaagttgggaggatcacctgaaaccagaaggtcaaggctgcaatgagccatgatgccaaaccacactccagagcctgggcaatggactgagacccatctcaagaaaaaaagaaaagagaaaaaatctgaacacagaattaacaatgaacatagccaatcattacgataaatacttctaaattcatgaaaaaagtagccgggtgcagtcgctcacacctgtaactccagcactttgggaggccaaggcaggtagatcactagaggtcaggagctcgagactggctgggctaatgtggtgaaaccccattagcagggtgtggtggtgcgtacctgtagtcccagatactcgggaggctaaagcaggagaattgcttgaacccaggaggcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggaagttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcagaggctgcagtgagccaagaaggcgccactgcactccagcctgggcaacagagtgagactctgtcccaaaaaaataaattataaattcatgaaaaaactatttttttaatgaggccagaacacatttccctagggaaataatatataaaatcaaattaatgttcctattcttaaatgcctaactttatgatccttagtattctgagttccagaaacaaaggataattaggggcaaaaggtatagaagagcagagacaaacgtgagaattgcctttcctggacctcaggaagcattttataataggtaaaaatagttttacaatatcccacttcccttctgtgccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacgagcctggccaacatggtgaaaccctgtctactaaaaatggtggcacatgcccgtaatcccacctactcaggaggctgaggcaggagaatcatttgaacctgggaagcagaggttacagtgagcagagattgtgccactgcactccagcctgggcaacagagaggctccatctcaaaaaataatcataattttaaaacaatatggaaatccaaaggaatacacacacacacacacacacacacacacacacacacacacacacacacacacaaattagcattagtaaacaagttcagccgggtgcggtggctcacacctgtaatcccagcacttagggaagctgaggcgggtgggatcacctgaggtcgggagtatgagatcagcctgaccaagatggagaaaccccgactctactaaaaatacaaaattagccaggcatggtggcacatgcctgtaatcacagctacttgggaggctgaggcaggagaatcgcttgaacccaggaggcggaggttgcggagagccgagatcgctccattgcactccagtttgggtgataaaagcaaaactccatttcaaaaaaaaaaaagaagaaaaaaaaagttcagcaaggccacagaataccagatctataaaaatcttttatttctctataccagcaatcaacaacacaaaatgaaataagaaaataattccattttcaatagcatcaaaaggaataaaatactaaggaataaatttaaagtaaaagacttgtacactaaaaactacaaaatagctggagaggatgtggagaaataggaactcttttacactgttggtgggactgtaaaactagttcaaccattgtggactacagtgtggcgattcctcaaggatctagaactagaaataccatttgacccagcgatcccattactgggcatatacccaaaagattataaatcatgtgtcttttaaagacacatgcacatgtatgtttactgcggcactattcacaatagcaaagacttggaaccaacccaaatgtccatcaatgatagactggactaagaaaatgtggcacatatacaccatggaacactatgcagccataaaaaaggatgagttcatgtcctttgtagggacatggatgaagctggaaaccatcattctgagcaaactatcacaaggacagaaaaccaaacaccgcatgttctcactcataggtgggaattgaacaatgagaacacctggacacagggtggggaacgtcacacactagggcctgtcatggggtggggggaggggggagggaaagcattaggagttatacctaatgtaaatgatgagttaatgggtgcagcacaccaacatggcacatgtatacatatgtaacaaacctgcacattgtgcccatgtaccctagaacttgtaagtataataataaaagaaaaaaaaactacaaaatacattatatatatatatacacacacttttttttttttttttttttttgagacagaggctcactctgttgcccatgctggattgcaatggcaggatcacagatcgacgtcctgggctgaagggatcctcccaccttatcctcaccctgatgagtagctaggattacaggggcaagccaccacatccagctaattgtgtgtgtgtgtgtgtgtgtgtgtgtgtgtgtgtgtgtgtgtgtgtgtgatatgtcggccagactggtctcgaactcctgggctcaagcaatcttctcacctcagcctcccaaagtgctgggattacaggtgtcagccaccaccacactcagcttaaaaaatattcttgaaagaaattaaagacataaacaaatggaaaggcatcccacgttcatgaagtggaagatctgacattgttaagatggcagcactctctaaattgatctacagatttaaggcattccctatcaaaattccaactgccttttctgcaaaagttgccaagttaatcctaaagctcaaatggaaatgccaaggatccagaatagccaaaacaatcttcaaaaaaacaaaattagaaaactcacacttcctaatttcaaaacatattacaaaagtacattaatcaagacagcatatttatgcagatagtagcagatagtagtaccacagggtgaaaatacaagaaagcaagcatgatggtactggcatagacgtacaccaatgcaatagaattgaaagtccaggccgggcacggtggctcacacctgtaatcccagaactttgggaggccgagtcaggcggatcacttgaggtcaggagttcaagacccgtctgaccaaaatggtgaaaccccgtctctaccaaaaatataaaaattagctgggtgtggtggtgcatgcctgtaatcccagctactcaagacgcagaggcaggagaattgcttgaacctggaaggcagagaggttacagtgagctgcgatcacgccactgcactccagcctgggcaacggagcaagactgtctcaaaaaaaaagaaagtccagaaataagcccacacctctgtggtcaattgactcaaaacatggatgctaagatgatacacaattcaatggaaaaagaagtcttttcaacaactggttcaaggacaactagatatccacacaccaaaaaaaacaaatgaaaaagattttgggccgggcgcagtggttcacgcctgtaatcccagcactttgggaggctaaagcaggtgaatcacccgaggtcaggagttcgagaccagcctggccaacatggtgaaaccccagtctctactaaaaatacaaaaattagctgggtgtggtagcgggcacctgtaatcccagctacttgggaggctgaggcaggagaatcgcttgaacccgggaggtggaggctgcagtgagccgagatcacgtcattgcacttcagcctgggcgacagagtgaaactccatctcaaaaaaaaaaaaaaaaaagaaacaaagaaaaagattttggattcctacctcacacatcatgtataaaaattaatttgaaattgataaaaaaaaaactaaatacaacagctaaaactataaaattatttaaagaaacataaattacacctataatcccagcattttgggaggcaaggaaagcggatcacttgagcccaggagttcgagatcagcctggacaacatagtaagaccacatctcagccgggcgcagtggctcacgcctgtaatcctagcactttgggagcccgaggtgggcagatcatgaggtcaggagatcaagaccattctggctaacatggtgaaacttcatctctactaaaaatacaaaaaaaaaaaattagccgggcatggtggtgggcacctgtagtcccagctacttgggaggctgaggcaggagaatggcatgaacccgggaggtggagcttacagtgagcagagatcgcaccactgcactccagcctgggtgacagaacgagactacatcttaaaaaaaaaaaaaaaaaggttaccaaaattagccaagcatcatggtgcacacctgtagtcctacctactcaggagactgaggtggaaggatagcttgagcctgagaggtggaggctgcagtgggcagatatcatgccactgcactccagcctggacaaaagacagagaccctgtctcggaaagaagaaagaacgaacgaacgaaagaacaaacgaatgaaaaaaacaaacaaaagagaaatctttatcaccttaaattaggcaatcgtttcttagatgtgacacctatagcacaagcaaccaagaaaaaactagataaactggacttcatcaaaatttaaaacttttgtgtttcaaaagatactatcagtcaggcatggtggctcacacctgtaatcccagcactttgggtggccaagcaagaggattgcttcagcccaggagttcactgggcaatataaggagaccccatctctaattaaaattgttttttttaattatccaggtgtggtggcacacacctacaatgccagctatccagaaggctgaggtggaagaatcacctgagccctggaggtcaaggctgcagtgaatcatgatcgcatcactgcactctagcctgagtgacagagcaagatcttgtctcaaaaaagaaaagaaagccaggcacggtggctcacgcctgtaatcccagcactttgggaggcggaggtgggcagatcacctgaggttgggagttcgagcccagcctcaccaacatggagaaaccccactctactaaaaatacaaaattagccgggcatggtggcacatgcctgtaatcccagctactcaggaggctgaggcaggagaatcgaatcacttgaacccgggaggcggaggttgccatgagctgagatcgtgccattgcactccagcctgggcaacaagaacgaaactcagtctcaaaaaaaaaaaaaagaaagaaagaaagagaagaaaaaaataattttctggttttaatttttttttttttatagagacagggtctcaccatattgcctgccccaggctggtcttgaattgctgggctcaagcagtccaccctcctcagcctcccaaaatgctaggattacaggcatgtgccaccacgcctggcgataaataattttttaaaaggttaaacataattaacacataaccaagcaattctccttctaggtatttagacaaaaataaatgtccatataaaagcatatcaatcttcacagagcattattcataatagctaaaaaatgcaacccaaatgttcatcaatggatgaatgcataaacaaaatgcattatatccatgtaatgtaatattattcagccataaaaatgaatgaaatgatacatgctacaacatggatgaacctaaaagcattatgctaaatgaaagaagccaaacacagaaaggccatttattgtatgattccattaatatggaatgtccagaacagacaggaagatgattagtggttgccagaggctgggtgaatgaagggaatggaagagactgctaacgggtatgaggtttcttttgggggtaatgaaaatgttctggacttagataatggtggtagttgcacaacattgtgaatacaccaaaaaccactgaattctatgattttgttttgttttgttttgacagggtcttgctctgtggcccaggctagagtgcacgatcatggctcactgcaatctcaaattctttggctcaagtgaatgatcctcccacctcagcctcccaagagtctgggactacaggtgtgcaccaccatgcctggctaattttttttttttttttttttttggtagagacagggttgccatgctatgttgcccatgctggtctcaaactcctgggctcaagcaatcctcccacctcagcctcccaaactgctgggattacaggcatgagctaccatgcctaccccaaattgtatgctttaaaatggtgagttttacgatatgtgaattatgtatcaacttttttaaatgtggaatgacatatgcccaaagatatacattggggaaaacatcaaagagtagggtagaaaggggccgtgaatgaccttctaaaggtgaaacttgagctgatatgtagagaactaagcctgtaaatctgccttatcccccactttctctgctcccaatccttcctaaactgagaaatcacttgtcacccaaagcaacacactcactacccaaattcaaattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacttgagcctaggagtttgagaccagcctgggcaacatggtgaaacgctgtctctacaaacaatacaaaaattggctgggcatggtggcacgtgcctataattccagctactcaagaggctgaggcaggaggatcacctgagcccagaagttcaaggctgaagtgagctgtgattatgccactaaactctggcaacagagcgagaccctgtctcaaaaaacacacaaaaatccgaaatctgaaatgctccaaaatctaatactttttgatgtcaaaggaaatgctcactagagagcattttggaatatctgtatactacagatattccaaaatccaaaaaatccaaaatatgaacaattctggtctcatatttcaaataatggatactcaacctatatctgattaagaatttcaaggctggagctgggtgcagtggctcacgtctgtaatcccagcactttggcaggccaaggtgggcgcatcacttgaggtcaggagttcaagaccagcctggtcaatatggcaaaaccccatctctactaaaaatacaaaaattagctggggcctggtggtgtgcacctgtactcccaactacttgggaggctgaggcaggaggatcgcctgaacccaggaggcagaggttgcagtgagccgagatcacaccactgcattccagcctgggtgacacagcaagactccatcttaaaaagaaaaaaaaagccgggtgcggtggctcacacctgtaatcccagcactttgggaggccaaggcgggcggatcaagaggtcaggagatcgagagcatcctggctaacaaagtgaaacaccgtctctactaataatacaaaaaattagctgggcacggtggcaggtacttgtagtcccagctactcgggaggctgaggcaggagcatggcgtgaacccgggaggcggagcttgcagtgagccgagatagtgccactacactccggcctgggcaaaagagtgagactccgtctcaaaaaaaaaaaaaaatctataaataaatttgttgtaactttgtcttctgacaataataaaaggcttagaaagcacatttcacgagaggtagctgggggaaaagccactagtgtggaaaagaaaaaggtgggacaaaataactgtcattgaataggtgcaaagttgagattagagctacagggaataactgtagacagaaaaattaggaccactgaagagaaactgcagggaggcagatctacaatcattatccggaaaatctttctaaaatgacaaatctgcaaacctggaattggtagcaaccagctgtgaagtacttatcttgggaaatacctgcatagagaactggaggaatcacctattatgtgaaacatttgtctagattatctctaaatctcttctatgattctacgaggaggaagaagtccagaaaaagaattgtttttgctctcaatactgctgaaagtattttttttaaaaaagctaaataccaggaacttctttaattaaaaggaacaatcccatcaagaagacaaaggttgatttgttagtcaagataatgagactgctttccttaggatcaagtatagcactgggagtgagaataggtcatttggccaggaacagtggctcacacctataatcccagaactttgggaggctgaggtaggaggattgcttgaggccaggaattcaagaccggcctgagcaacatagcaagactctgtctcttaaaaaataaataaataggccgggtgcagtggctcaagcctgtaatcccagcactttgggaggctgaggcaggcggatcacgaggtcaggagatcgagaccatcctggctaacatggggaaactctgtctctactaaaaaaatacaaaaaattagccagttggccgggcgccctggctcacgcctgtaatccgagcactttgggaggccaaggtgggcagatcacgaagtcaggagatagagaccatcctggctaacacggtgaaaccccgtctctactaaaaatacaaaaaattagccaggcgtggtggcgggctcctgtattcccagctactaaagaggctgaggcaggagaatggcgtgaacccgggaggcagagctttcagtgagccgagatcatgccactgcactccagcccaggcgacagagcgagactccatctcaaaaaacagaaaaaacattagccgggagtggtggcaggcgcctgtagtcccagctactcaggaggctgaggcaggagaatggtgtgaaccccggaggcgcagcttgcagtgagccgagattgcgccactgaactccagcctgggaaacagcgagactccatctcaaaaaaaataaataaataaaataaataaataaataaataaataataaatcttcaattctagatacaatcactcacttcctgtttggccaagggtaaatgatttcatctctctacctgagctgaaaaacagtaatttaaaataccaatattataggagtataatttaaattagttaacaactgcaaaatgctttggaaatttactttatatgacaattaagactattttttacttcatatatatattagagttgaaaaaattagcatgtattattcattaaatcagccaaatttctcactttcagagaaagaagcaaggaagagaatgctagaatgaactctgtggtgctggatcagcatcagagatatcagtataaactcatgtttatatttatatacagacagatacggaagtaaacgaagatatgtgtgggtcagtatatatatatattacttcctaactatcccctgagagggcctagaagcagtgataccctagcagtaatgagtgcatcaagctcatttagaaaccagatagtggtttccaaatactcttctccaacagaaggaaccaggacaccttggagaaatggctgattttagggttggggcaggtaaagtacaagatgagactggggcatcttacagtgccaggaagtacaaaagtgctaaaagacaaagaaaggtagggaaaggtatttcaaaagaacataggtgccaatgttagaatggccaaagctggaacaacttgagcaacaaaatacagtactggattataagcaaagaaaaaaatattcatgggtccatgttgacataaatgatttaataaataaatgggggaggcataaatcttccttacaaaaggattccaaatcataaaagtagaaagaattagaaaaatagaaaaccaacagaataatataatcaacgctgccgcaggcaagattcactaatgaatgctaaaataagtagaggaaatttttaaggagaaatcagattctgtataacctcacagttatcttccccaaaatattaactaattactttaggaattttaacatgcccacaaattctttgatactcctcccttcaggggttggagcttaattcccttcccccagaatatggatatgacttggtgactcatttctaggttctatcaagtaaaattaaaaagcagaacaacagtcactttacagtgcagaacatcactttaatcaagttatcaaagttaacaaggcacaatggctcatgcctgctatcctagcattttcggaggatgaggccggtggactgcatgaggccaggagttcaagaccagcctgggcaacatggcaaaaccctgcctttactaaaaatacaaaaattaggtgtggtggcacgtgcctgtggtcccagctacttgggaggctaaggcacaaaaatcacttgaattgggtaggcagaggttgccgtgagccaagatcatgctactgcactccagcctgggcaacagagcaagactttgtctcaaaaaaaaaaaaaaaaaaaaaagttaatcagtaacgagtcatgttgatatcaggtattcccagatatgatgtgacaagaagggtaaaccatctctatggtatttttccccaaaatgcataacctcgggctaatcatgagaaagcaccagaaaacccaaaatgagaaccattctacaaatgcatgaccactcatctttaaaggtgtcaaggaaagatagggaaggagagactaagaaactgtcacctattggaagaaactaaagaattgtgacatctaaatgcaatgtggtatcctggattggatcctgtaacaggaaaaggacatcagtggaaaacacaggaaaatcagaggaaagtctgtagtttgctcaataatattccactaatgctaatttcttaattttgataagggtatcaggttatataaaatgttaacgctaagagaaatggaatgaatacagaatgtatatagaaagtctgtactacctttacaactcttctgtaaacctgaaattatttaaaaggagttttaaactattttccatataaaaagaagtgaggaaagttataaataaaaaaatttattttttgagacagtctcgctgtagcccaggctggagtgcaatggtgcagtctcggctcactgcaacctctgcctcccgggttcaagtgattctcctgcctcagcttcccgagtagctgggattacaggcgcccgccaccaggcccagctaatttttgtatttttagtagagacggggtttttaccatgttggccaggctggtctcgaactcctgacctcttgatctgcccacctcagcctcccaaagtgctgggattacaggcatgagccaccgcacccagcataaataaatttttaaacatatttaaatatatgcaaactaataaaatattagtttacagtaagattaactttttttttttgagatggagttccactcttgttgcccaggctggagtgcagtggcgtgatcttggctccctgcaacctgtgcctcccagattcaagtgattctcctgtctcagcctcgcgagtagctgggattacaggcgcttgccaccatgccagctaatttttgtattttagtagagacagggtttcaccatgttggccaggctggtctcgaactcctgacctcaagtgatccccctgcctcggcctcccaaagtgctgggattacaggcatgagccatcatgcccaagccaagaagattaacttttttaacctataaataatcacaatagctggtcgcagcgggagtgcctgtaatcccagctactcaggaggctgaggcaggagaattgcttgaacccgggaggtggaggttgtggtgagctgagatcgcgccactgtactccagcctgggaatacagcgagactcagtctcaaaaaaaaaaaaaaaagaataagaacaagaatcacaaaagttagccaggtgtgatggtgcacatacacagtctgaactactggggaggctgaggcaggaggatcacttgaggccagaagttcaaggctgcagtgagctatgatctcccccactgctgacagaacatgatctcatctctaaaaaaaaaaaaaaaaaaggaaaaagaatcacgaaagtaattgtgttgactttcaaccttaaaatgttaatgacatccaaaatagttcaccataaggtctgcatttaaagactggcctaggagctctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttgttttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggtcaaaatgttcctctcagattttctcacatcttaaggaaatctaaaagctacatagcaactactcacgcttaatctttaaaaaaaaaaaaaaaaaaaagcaaagtgattccaaaaactgtcaagagcaaaagtttacagagccaaaggattgatcaccaaattcagaaacaagattaggaaagaacaagacactatgagattaggaagaacaagacactatgagattaggaagaatctactctctgactaaagctaagccgcctatatataagaaaatccaggtgcttccttcactgtcagcaaacaatggaaaatgactttttaataggtaatataaatgtatttgtaaatttgaaaattttaacaaagggatgctggaatgacaaatatttgaagagactacttaaaaaacaagtgagacagagtaggaaaatgtgttaagacatcctccagcactgtatgtgtttttacactggggaaagggagactcactagacttttgttccttgattaaaatacccgtaaggccaggcgtgatggctcatgcctgtaatcccaacactctgggaggccgaggtaggtggatcatctgaggtcaggagttcaagaccagcctggccaacatggtgaaaccccatctttactaaaaattcaaaaattagccaggcgcggtggctcacgcctgtaatcccaggactttgggaggccgaggcaggcggaacacgaggtcaggagatagagaccaccctaacacagtgaaaccctgtctctactaaaaatacaaaaaattagccaggcgtggtggcacgtgcctgtagttccagccactagggaggctgaggcaggagaatcacttgaacccaggaggcgaaggttgcagtgagctgagatcgtgccactgcactccagcctgggcaacagagtaagactccatctcaaaaaaatatatatatatgtgtgtgtatatgtatgtatgtgtgtatatatatgtatatgtgtatgtatatatgtatgtgtgtgcacgtatatacacacactcacacacacacacacacacaaattagccaggtgtggtggtgggtgcctataatcccagctatcaggaagctgaggcaggagaatcacttgaacctgggaggcagaggttgcagtgagccaagatcatgccactgcactccagcctggatgacacagcgagactccatcttaaaaaataaaatagaataaaataaaaataaatggccgggcatggtggcttgcacctgtaatcccagggcactttgggaggccaaagcaggcggatcacttgaggtcaggagtttgagaccagtctgtccaacgtggcgaaaccccgtctctactaaaaatacaaaaatcagccgagtgtggtggcacatgcctataatcccagctactccggaggctgtggcaggagaactgcttgaactccggaggtagagtctgcagtgagccgagatcctgccactgtccagcctgggcgacagagcaagaccctgtctcaaaaataaataaataaataaaatttaaatttaaaaaatacccactaagaatatctagtgcctttccaattccataatcaactacctttttattactgattaggcagcccagaacaatggaggtgtcctggtcagtggacaattaaatccaattgtgcacatggcacttaatacttccaacatgcattaactggtatctggtttatcagtctctggtgagtttgtttactttgcatgaataaattctcaagcacttgaatcatcccaatgtaaaccaaaattctgaagtttctgaactactatgtgggggttggagagaccttggtttggttggataccatttttgccacttaactatctgtgtgacctcttcttcccatcagtctcaatttcctcatctgttaacaaacatagctagtgcctgggagatggcaagtgctcaaaaagtgacagctttattattttgaagctaaatttgaaaggaagtgtgtaactgaggtgaaaacatttcatttgaaaagtagtagtacggatcagcaaactacgttaatttaaaagacacagcctgaagagagatgtcccaatctttggagttgagaaaagcaaagtttaaaagttgcaagtaaagtacacactgcacagtacagatgggagtctcctgcttagcaactttaatgttgtctaccaaacacccagcttgtaatagagcatgacaactgttcactctaaatccatgtgctcagcttggattcaggattgatttataaaaatagctgctggtggtgctctttgaatctctttgggctgatgactgggcagtgttaccccaaaggcctagagcagctgtattccctcaccacacccatttctctgtctacccagccaagctgacggcaccctgcccccgccccccatctctacagcatactattcaccctcctcctgggctgagtgagcaaattacaagcacaaatatcccctgatgcaatgccacaaccatccctgggaaagagcagaggcagttgccaaaagcacagcagcagggaaatgggcgggagacgcgcgcgcgcgcacacacacatacacacgcacgcgcacacacacgcacgcgcacacacacacacacacacacacacacacacactgcaagaaacactgcaatgctatgcaaccagggagagagaatcgagaggccctggggagcaatactgtaacaggaccagagaaggcaaaggagaaaagggggtttccagtagaaagctgggtaacactaaccttcgcgaggaacacgtatttcatccgagcttgggtcctaaagcacaaacctaaaggtaatcaatcactgcctcttccccaaagcagcaaatgcatttaatttacccgttcctggaagtgagcaaaaccctcacaactcctccacaggacaatttcaccaaagggatctaactcacaccggcggagaacttgttccatgtgctaaatcacaatctctgttctgggtaatgtttccaactgcctctcctagtccctgtaccctccccacccccaccctaatgtgaccctttcgcactcccactgccagacacacgctttagtccccacacagtgtcggggcctttgcaagggggaagagccccgcctagggcccggttctccagaccacccctcagccccacccataatccctgactggacatactaaggctcacctcagcctcacatcaactgacccccacaaagcctcagaaaacgacccctgagttctcctacacctccgaaccccacccagggccccagactgcggccgaccctcgctccgcggctcagccccatccagagcccaaggcatgtcgctcggccccaccgccccgaccctcaaaagctggacctctcagcccccctcactccaaagacccccctagatcgcgcctcaaagactccgaaggtcaaagccgccagccccccgcctggccccctccctcggacgcccccgcgtctcgcaggccggcggccaccgcccttccacgcctcgggcgggccccgtggggtacccagctgccgcagggcaaggctcgggcagccccgggacagtgaggaggccgcccctccaatcggaccccgcctgcggctgcacctacccgccgccgccgagacggagctggggcagaagggagccaggagagcgccgggaagagccgtgaggaggtaggagacgtcgggaggagccgggagccagcgagctagccggaggggcggggcgcagggaggcggccgcttcctcgtcgcctcttgagggccggcgcaagggagggacgccgccaccgcctacccggcgagcgccgccgctccggccaataagcgtggcgagggggagggcggagggctgtggcggaccaatgggtgctggccctgccgccacgacgtctctgcagagctgcccgagccgcgggcggttggggcgaggtgcgcctgggggctctagcctcccgcctgcggcctgcgaatgccgaagcggaccgcaggccgatcgactgccttcgctgttctatgatggccgtcgctctctctcagagtctgggcgcccggagcgaggagagtgcgagagtcggcgcacacgcggaccgggccaccagcgggtggggcct

SEQ ID NO: 414 - DNA, 236509 bp, Homo sapiens
tgttcgccgattcctttatttatttaggaggtgggggcaggacgcggagtaagtttcctatagggaaagagttgagaagagtctgcagggactgacctagaaagcagtgacactccgtagttggaaaaaagcagagcacatctttaagtacctggtgtgagttttgtaagaaaacctaccttatgaatgagtacagtggaatactacttagtacattcatacatgtttctaccatctcaagatttttatatatacagtatatgatctgtttttataaatgtacagcttgaaaaaagatccttcttgtagtaagtacagcatttaaacacaaaccaatatgggccagccacattctaattgaagacccagagaaagcaaagccagcagcccagcccccagcccccagcccctgacctgcttggcggccctgatggtcccggcaaagtgtaaaccagtgcccctctgtcgccctgggctcagcaggccagcttacccttggcacgtacatgggaagtgcctgctcacgctaagcccagtctgcagagggcgggtcctccctgaaggaaggtggcagagaggaatgtgtctatcaggtatggacaagagagatgaaagaaatgtgctcttcaactaaaggcacttgtcagcggccacctacagccattctctaggcctggtgagcaagcagggtgctgttttgatagaagcctacaaggtctgagcagacctcacttgtcctctcaccaggtttaaatacaataaataaatcttaatgcatggtggttttgtcctcctgggttcctatgaagaggctaccttttaggatcacttatggagtgatactccctgtccccaacccagccttttcagtgtcctccatggggaaggtaccagaatagctccaggccttggagaagcaattgctcattgtggattgtaaggggagcccctaaatatcccctcccctggtctgtgcctggagctcctctgccccatgtgtcagagtcacgggcacctcagatcttggtcacatagttgttggggaacaggccctgcttgcctcgtagtcgacccgtccaccagccagaaggatctgcagggagagagaggtggtggaagtgaagatgagaaagtctgttctgccccagccacacacactccgctcccatgggctcaagtgatttggctccatccatgttgttttccctttgttctttaaatcaaaaagtttgttgaaaaaagtaagatatctaccaaattaataaagcactcagccaagcccatggactgctttaataatggatattcaaggttgtcttcctggcttccactccatccactttcattatgaagaagccaggaagtgtgggtgggacagacctccccgtttctggggacagcccctaccaggtctcatcctctcagggtacagcctttgtcttgctactgaagttggttcagggatggacacatggctaatttggtctgatcagaataaaagtcaggacttttgtccaatgactaagaacagaagtttcagagatgatgcacatttcagacatggtttgatatgttggcctggaattgctgctgccgttttgctaccatgaagaaaaacagcttgacaagggagggaatataaataagggggcagagctgaaagaagcattaaaaaagctggtgtcttgatcagactgagcctgaggcctgacctgcctctacaaattgcagtttgaggagcccataaattcttttcattttcacactagatcttacagcaatgtgactgcatgctctttgggaggctgtcccagccaaccagccacacacttaccttctttgataatatcaataatgtcattggcattaaagctgagttcgtctgtgtcctgagcgtcataggcatacaaagccttgcactgtggcacctgaggcttgggcttgggctggggcttgggtctgccccctgctgggggaggccgactggttgtttgtctcctgaccctgtggagagagtggagcagatgagactgggccccaacagggggcagcagcaccgaacggtggtttggagcatggcggccggcactggcctgttcaagttcaaatccagctccatccttagaagacatgtggcccagggtgcagtctttaaacttgaggaataaaagtaacttttctgacaaggttgttgcaaatgcacatagctcttaaaaaccttagctgctgttgtcactgtgtccccagcatagaaggaaatgtgggagacacatatccataaaaaagtgtcaaaagtatacccatacatttaaatcaggaacattcaggtatctgtccctccttcctcaagtttcgaaatggaacttttgcaggtgccacagaagcctgtaggcatttctccttcactgcattccccccagattaccaccaccttacagtttgtattaaccattctctggctcatctctacagtttgccacacatgtaaatacccctagccaatatttgtggtccgactgtcaactgtatgaaaggaatcatattccacggtcacatgctcaacaactggatgacgtgccctgctgatgcctgcagctatcgttccttcacccttgctgcctgatactacaccactgcgcgagtgagtgtgtcacagtttacttctccagggcactgtggatggtcacttgggatggttccagttttcactattataaaaaatgctgccatgagatttgctccccattcacaaccttattatgcctcagacctcactcctgtctactcccatcccatctatccacccaccctcattactccagagacttccctcccaccagttcattattactccttagacttccctcccatccctcattattactcctcacacttccctcccaccccctcattattactcctcaggcttccctcccacccccctcattcctcctcagacttccctcccaacccctcattattactcctcacacttacctcccaccgctcattgttactcatcacacttccctcccatccctcattattactcctcacacttccctcccaccccttcattattactcctcactttcctttcacccgctcattactctgcagacttctttcccacccccttattactctgcagacatccctcctaccccctcattattactcctcagacttccgtctcaccttctcattatttcttgtcaaacttccctcccatccctcattattactctgcagacggccctcctaccccttccttattactctacaggcttttctgccctctcattattactccacagatgtccctcctacccctcattattactctgcagacttccctcctacctcctcattattactcctcagacttccctcccgtccctcattattactcctcacacttccctccgacctgctcattattactctgcagacttccctcataccctcatcattactccacaatcttccctcccaccccctcattattaatccacagacttccctctcattttatcaatcagttattactcctcaggtctccttcccattctttcattattacccctcagagctcccctttgcccctccaaaaatgttgctgtaaatattcttatacaagagtttatccagagcagtttctcaacatctgcactactgacatttgcggctgggaattctctgttgtgtgtgtgtgtgtgtgtgtatgggggtgggtgcgggaggctgtcctatgccctgtaggatccctggcctctacccactggataccagtgacactcccttcaccccactgtcataattattaaaaataactccagtgctctaaccctaatccagatcttctagctttaaagttattcttcctatatactatgctgccttaagtcaccattcatacattctttcaaaggtgtgtaagttcaacttgttcctatttagtgagatctttacacttatacctgaaacatttattaaatatgttcataaaaagcatttagcaaaaacaaaaaggaaaacggaaacatggagaacatttctttttttccacttcgcttaaggacaaaccaaagtaaaggctacattcatttccctacaaaacaaacttaagatttctccctcaagaagttgggctggacctcaacagggtggggctggctgttaggtctgtgcacatcattcacacctacaggagcaaggaggaaaagggagggccttcctggggcctgagttctggaaagaacaaccacacccagttttgagctgtgctctcaggagccacagcctgctggccttgcccaggtcctgtgatgacagatgttcatggggtgctgatgaacaacctggatcacaaaggggtggctggggggaacactgactgccagcagggtggtggactgtccccaggaggggctgggcgcccctgagactcggcttttacaccaccccacgtgggagggagcaatcctcaaggctactcaggctccactcctcccaccaccaccacccccctgcacttttctcttagtgcagaggaaaggcattttgtaggttcttagtgtgacatcattcgttttctacctagtgcctactggaaatccccattccctgttcaagaagtgcttgcttctctgaaagttggccaggcgagcaggtttttaattaagcaccctatatattgggatgtgtcagcatttggttaataagagccattagcctggataccagacgtcatgtgacttctcagcaacaaggaatgaaaggggatggcggcgggcattacaacaccctgggagggaggaagcctccagcctggcagtccacagaactgggctacaagtgcacatggaaggacacagatgcacacatgtgcacgcacacacaccaaaaactcatccctatctccctgggggactggttccaggactcctcacagatactaaactccacagacacgtccctcatatgaaagtgtaacaattgcatataacctatgcacatcctcctgtatacgttaaatcacctctagattacttataatacttaatataatgtaaatgctatgtaaatagttgttatactatattgtttagggaataatgacaagaaaaaggctttttaaaaaatataggactggctaggcatggtggctcacgcctataatcccagcaccttgggaggccaaggcgggtggatcacctgaagtcaggagttcgagaccagcctggccaacatggcgaaacccgtctctactgaaaatacagacggtagctgggcgtgacggtgcatgcctatagtcccagctacttgggaggctgaggcaggagaatcgcttgaacccgggagatggaggttacagtgagtcgagattgagccactgcactccagcctgggccacagagtaagactttgtctcaaaaaaaaaaaaaaaaaaaaaggctgggtgcagtggctcacgcctgtaatctgtaatcccagcacttggggaggccgaggtgggtggatcatgaggtcaggagatagagaccatcctggctaacacggtgaaaccccgtctctactaaaaatacaaaaaattagccgggcgtggtggcgggcgcttgtagtcccagctattcgggaggctgaggcaggagaatggcgtgaaccagggaggcggagcttgcagtgagccgagagcgtgccactgcactccagcctgggaaacggagtgagactccatcccaaaaaaaaaaaaattttttttttaagtctgtacatgttcactacagaggcatctatccatattttttctgaatattttcattccaagtttggttgaatccacagatgtggaacccatgggcacagcgggccagttgaacccacagatgctaatttgtcctgtcttgttcagggaaaaaccctagtgtccttagtgtagactgacaaggtctctggagcccaagtatgggggcttagatacagggtcctcctgctgaaggactcccctcgccagggtcggggtaagacctcttagtgggaagacaagacggatggctcctgagaggtaagaccctccctgccctgggcatcacccacttgttctgccccacctgcctccagctttgactaagacctgtttctgtccttcgtgtcttccttgccagttgtttcctttctaggacacttggccctcatgctagctcagctgttattagttcgccccatcctcaacctgaaaatctttctaacagcttctctctgctcttggaaaaaggaccaaaacccttcatggcgcctacagactctgccaggggcggcccctgctcacaccccagccttactccctgctgcaggccacattggtgccttcctacctttcttcatgagccctggttggggagaggacccttgtccacatacttcaagcttacatcatatttactggtgaaactcacaatgatttccccataagatcaggaacaaaacagggatgtcagcactcaccacttctgtccaatattatcctggaaactctagccagggtaattaggtgcaaaaaaaaaaaaaaaaaaaaaaggcgtctagattgttttaaactagagatcgtaagtctcatggaacggattctttctggtgataagataccaaattataaataagacctaaggggatgcaggacgcaaaaagctgtgtgtatgtggccactgcgtggtctttgatatcaaggcatcagaggctacttcctcaggataagtgactcctggccaaagtaaaacctccgaaattacccggggaatttggggtccataattgtccaggttgtggacaactgctaccatgctggcagtgtaagccatttggccctttatcactaggctgaatggggttcctagtaactccacaggtgagaggtgggggaggccagggcagctttgagatgggtgtggatagtggggactgtctgatggcagccgggaggagtgggcaggtgggtggaggagggaggacctctgcagtttgcactttgcattaggaagggcaacactgatgctgccaccattggctctgtcttgtgaccacaaagaggcacagctgctttgctggggcggcatattcccaaagcgagccacagtgagagccattctccctggccagcctgcacatgtctacacccttcttgtgagggctagcagacaggatgtcttctgggaaactgccggtagctgtgtgaagtctggataaactcccctcaactcagccaggccttgtcctaggcattttcacagatgctgcttcatttcaccctcacgacactcctgtgagatgactgatgcaggctcctgggatttcctgctggtttcatccctggccaacatggtggcacacgcctaaggctcctggcactgcagccacatggaatctttctggatccttggtctggctatgctcccctggcctctgcccacttcccaggcagcactgctaactcctgctcggccttcggatctcatttccatcactgcttcctcatactctggcaaacccccggccataccctctcctagcccacggcttctccagaacatgggtcaattgtagcatgacagtgacttgtgtggctatttggctaactccccctgagatggggcctcaagctctatgttgacagtgtgtagcaggagggggacgtgggcttgagtctgtgtgctgggtttggggccaagctctgcatctgtaaaacctgagcagattcaggcaatggcctaggtcctttttctttttccttttatttatttattaatttatttttatttttttgagactgagtctcactctatgacgcaggctggagtgcagtggcatgatctcggctcactgcaacctccacctcccaggttcaagcaattctcgtgcctcagcctcccaagtagctgggattacaggcgcccaccaccacacccagctaatttttgtatttttagtagacacggggtttcactatgttggctaggctggtgttgaactcctgacctcaagtgatccgcccgcctcagcctcccaaagtgctgggattacagttgtgagccaatgcgcccggcctctttatttttagagatgaagttttgccatgttgcccaggctggtcttgaactcctgggcttaagcgatcctcccaccttggcctcccaaagtgctgggattacaggtgtaagccaccgcaccgggttccaggtcttttttctgattctaggaaagttttacagagagctctcaacagcactgaggaacacaggaaatctgtgtcaacgaagccgtcacaatctctacgattcaccagactggagacctggaagccaccttggaacacagttggtgggaacagccattttcccagactccaacagcctcgaaaacccaggcaatctcctctgcgtcactaggtggcaatcctgtgtcattaatgagaagaaagaatgactttttgttttgttttgagacggagtttcactcttgttgcccaggctggagtgcaatggtacgatctcggctcaccgcaacctccacctcctgggttcaagcgattctcctgcctcagcctcctaagtagttgggactacaggcatgcaccaccatgcccggctaatcttgtatttttagtagagatggggtttctccatgttggtcaggctggtcttgaactcctgacctcaactgatccacctgcctcagcttcccaaagtgctgggattacaggcgtgagccaccgcatccggccaggaatgactttcaaagaaactgccagaaatttgattaatgaggtcttctaggcaggtggagccccctactcccagccgaggcaattggctagtccaggaggaagggattacacacccccttacagggcacatgagacccgcatgcccactgtgccagaacaggcttagtccagcttgcgagagctgatagaactttcaggaattttgtgagccagttgtcaaacatggccattattaaaaaccaaatcattgacaacaaagaaattacattaaaacaaaagcaataaatgctcatcatttatctcttcctacttctcactgcaacctccgcctcccgggttcaagcgtttctcctgcctcagcctcccgagtagctgggattacaagcatgtgccaacaagcccggctaatttttcttttgtatttttagtagagatggggtttcaccctgttgcccaggctggtctcgaactcctggcctcaagtgatccacccgccttggcctcccaaagtgctgggattacagtcgtgagccactgtgcccagcctacttattttcctctatctatgcatttgaagttattaaagtctattgctgatgtatggtagaaatactatacaatggtgagactgcccatgttttcccaactccgcactcagtagtagtcacactggtagcttgaaattggccatgaagagagaattttaccatggaaactggtaaatgttacagttcaggccttttcctccctggagtgcccactgtttaccagcacactaccatcctaccatcctaccatcctcaagctgccctcacgacagcacaggctcactcatgtctaaaaatgccttgccaacttttgtttcattatttccttattgttattatttttagagacaaggtcttgctatgatgcccaggctggggtacaatgatatgatcatacctcactgcagtcttgaacccctggacttgggccatcctcctgctttagctatctgagtgctgggactacagccatgtgccaccatttgttttataattgtacaacttagataattttggtaggtctggtactctgtgatacagtatttgtatttctaataaacatcacagaattgaaaatcgtgttataaaaataattatttcattgagataatggttgttttttgttttgttttgttttgtttgagacagatccttgctctgtcacttggccggagtgcagtggaatgatcttggctcgctgcagcctccgcctcccagattcaagtgattctcatgcctgagtctcccaagtagctgggattataggcacctgccaccacgcccgactaatttttgtatttttagtagagacagggtttcacatgttggtcagcctggtctcgaactcctgatctcaagtgatcctcctgcctcggcctccagaactgctgggattaacggcatgagccactgtgcttggctagatgatggggagttgcagcaagatttcagactcacaataacttattttttcttttgacatttcaataataaaggctcattatatatataatatatattacttatattgtatatattatttatatatgtaatatacatatgttaatatatggttataaaactatacatcactgagcaaatccagtgtttcattatatgtaatttctgtacaatccaatttagttttcttattttagggtaatttgtacacatcactttatgtgtctattaccaattaacataaatgcacgaaaaagctgacccacagcaacttctttttgcaccaggttcttttttctgagtagggcaatcacattataacccagaaacaaataacatttcctgatgaattaagtacactacatccagtttgctttgtgaaaacttgctctgcaagagaagtcctatattagtgaccagagaagaccaagtgatatacttgccccgagacatttggatgtcagctgacatttgagtcctcatggatggctgccgaatctcacaaggtgccaaaagcccacaagaaaacaaaaccccaaatgacatgaaaactctctaaactgagggctaattccctctgccctagcaatgtccatcctttccatgggctgttcattgttatgatgactgcagctcagatgtttagttagaaagagaccgtggaggccaggtgcagtgactcatgcctgtaatcccagcagtttgggaggctgaggtgggcggatcacttgaggccaggagttcgagaccagcctggccaacatggcgaaaccccgtccctactaaaaattagccaggtgtggtggctcatgcgtgtaatctcagctgcttgcgaggttgaggcatgagaatcgcttgaacgtgggaggcagaggttgagctgcagtgagccaggatcgcgccattgcactccagcctgggtgacagagtgagactctgtctcaaaaaaaaaaaaaaaaaaacaatacaaaaaaaagaaaggaagagactgtggaacggtgcagagccagaaggagtttgtgacttttcatcttcaaattgtccaaatgaggctctcatgtctagtgattattaccattactgcagaactctgtgtgccactgatgctctgtgcccacggagaacaggcacagctgccaagggtgtgtgtgtgttgggggcgggcgtctccctgtctggtctccttgtcttggcttccctaggctgcccattccccgcattacagccaacaatgcctgaagcgtagaccttcatggagtccacagctctaggcaggccagagatttgagttcttgagaataaagccactgggccaggaaacatcacctttcaaccctggtagagcattaaaatttccttgcaagaccagccaatgaataatggtaatgaatcaaatacaaaataactttcaaatagcattgtgctttatagcacacaaagcccttatttaaccttcaagaaaaccctgaggagtgggttttcaaaattattatattagtatccctattatacaggtgaagacaccaagagtagaaagattaagtgacaagcctggggtagcacatagaaggcacatggctcagtaaatattgatgaataaaagaaaaaggaaagaatgaatgaaccaggactcaccctactcttacagatgcaaatcctgtgctctctgcactctaaatgccaccttttgtgaatttctctgtagctcccacacctcctgggtgggtgtgcctagtctatgtcgggggagctaggattaagctttcgaatatcacctctttgttctgcagatgggaaatttatgtcttgaaattccaagaaggaaaataatggcattttatttcactggctcttaaaaatatgctgtgttccaaaaggttgaatctataaacattactggaaatgtggaaatggatgccaggaattcctcagcaccatgtctgcctgggccaggatatggctgctgctcccatagattatgggttgagaaatattgctattggacacttgatggaaattttaagccccataaaaatatgactccattgggaggatcttgacaagagacacacaggcagcatttaaatatttctattgacccctcctttgtggcatgcccagaagccctaccactgagcacttccaagacttttctgtttttccaacttctagttggattaatctctggagtatcttgaaatttcctgaagttatcctcccacaaaatggaccacaggattaaaaaggtcaacagacatttccagtctgggttttaatgcttccaagaatgaactgcaggtagattaggtacatttcagttataggagggaaaattacaaagcacactggatagtgagatcagagcaaaggtgggtggatgaactgtttttttttttttgttttttttttttttttttttttgagacagagtcttgctctgtcgcccaggctggagtgcagtggcccaatctcagctcactgcaagctctgcctcctgggttcacgccattctcccgcctcagcctcctgattagctgggactacaggcacccaccaccatacccagctaattgtttgtgtttttagtggagacggggtttcaccgtgttaatcaggatggtcttgatctcctgacctcgtgatccacccacctcggcctcccaaagtgctgggattacaggcgtgagccaccgcgcccggcctggatgaactgttaataggattcttgcctaacctcttccctttccttgagaaacaggaaagatctttgacctgaattaagacttctcaaaagctatgctaatcgatggcaagatcctgattcccacgcagatctctcagtgtttcctggagaatgataatgatagctaccatgtgcaccaatactgcaatgaaagggtaaagaatccagttgggatggtaattaatttagtgaaatcttcatgctctcttcagaacaactgattgaacctaaaataaactgataaagacttgcctgaattaacttgaggtgctaattacatcatttgattttatccatattacatgatccaaaataaattacagaaaaagtgcactgagggatgagagagaggaaggaaagataaactcagaatgtgaaagccaggaaagaaagaccatagtaatcctacttttatagattggtaaagtcaaggtgactgtttagaactttgatgtataggaattttcatgtttatggaaaaagtacaaacttgggatcctaaaattccctgcatgcttcaacagcctcctgtggaataaatgcaattcatgttttcttggcaaataggagaagctgttaaatttaggtaaccatggggatccataaaatgccacatccaaagtctctggccacattagatacttttaattttcacctttacatgttttagaaaataaatactaagaaaaggctgagccttttgcccaaggtactattttgtaaggaatgtttgcacagcagatttaaggttacaaagaggaggctggctaagacacagtgtgcctactaattgtgttttacatacaaggaaatcttaatgcctagcagacaggtgtgaaggtgtcctctccttccggcctcatggcctgcctccaagacagcaccacgtgtacccagtctttaggctggagggtggcaaagggtgccataagacttaaatagggaaccacatggcagagggctggaagggagcagccttggttaagacacagtgttcctaaattgcctacttttggctgacagatgctcccagctggctgatgtgcaagtttgcaacttgcaaagtaggctggaaagatggttttgcttgccaaaaccaaagtaagtaggcagctagcacacagagctaagagatttggtgcattctgttgactgcttttaataccctgcctactttgaggcatcaaactgggcctaggtgggattgtgacttagtgatgctcacccacctgaaaggtgtaggtctgggttagagagcaaaaatcccataaacctaacagcacccttgcaattcaccttcacatggaggcttccctggctttatcaatcagactacaggtgccttcagaccagtggttttcaaaatgtggtccctggatcagagcatcacctgggaacgtggtacaaatgcaaattcttaggccctaccccagacctacagaatcagaaacgcggaaagtgggccagcaagctttccagcggattctactgcacactagagtttgagaactactggtttagaccaagccaatcacgtgaaccacggtcatgagagctggtgggatatagctacttacccaagactggggggtagtggaagggaagaggagagggacacacacacacacacacacacacacacacacacacacacgcgcgcgcgcgcacgtgcacttagagagaggtctacataagggcggcatccactctactgatggctgtctgtgtgataaaactaaggtgctttcagctgggcgcggtggctcacgcctgtaatcccagctactatgggaggacaaggcaggcagatgacgaggtcaagagatcgagaccatcctggccaacatggtgaaaccccatctctacaaaaaaaaaccaaaaaaattagctgggtgtggtggcacgcacctgtagtcccagctactcaggaggttgacgcaggacagtcacttgaacccaggacatggaggttgcagtgagctgagattgcaccactgcactccagcctggcaacagaacaagactccatctcaaacaaacaaaaaaccccccccaaaaaaaccaactaaggtgctttcatatttgtagcccaaatgaagtgagataagacttgccagggcaaaaggaatgctgctaggagagaacatggtaaagctcttaagagctctgtggtctttagaaggaagctgccaaggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaagtaaaaaaattaggctgggtgcggtggctcacatcttaattccagcactttgggaggccaaggcgggtggatcacgaggtcaggagatcaagaccatcctggccaacacagtgaaactcttgtctctacaaaaatacacacacacacacacacacacacacaaattagccgggcatggtggcaggcgcctgtagtcctggctactcgggaggctgaggcaggggaatcgcttgaacccgggaggcagagattgcagtgagccgagattgtggcactgcactccagcctggcaaccgagtgagactccgtctaaaaaaaaaaaaaattagctgggtgtggtggtgcgtgcctgtaatcccagctactcaggaggctgaggcaggagaatcacttgaacctgggaggaggctgcagtgagccgagactgcaccactgcattgcagcctgggcaacagagcgagaccctgtctcaaaaaacaaagcaaccaaccaacaaacaaaaaggtagatggatggctgccccctcagaggaaggagctgttgtttctcttcctgcacaggtctattttgcattcatacctcctgatcctcatttgaaacttctccatggtgctggagacaggagacagtggaaaatggaagtgggcttgagagaggggaagagaagagagagtgggtgggagcaggccattactagctttagcagacagagccactccaccatggagagtcgtgcagagctggaagattccttacaagtctctagttcaacctccatgaagtgacgggggtccttatgatcatcaccctgtcaccgtcattaccaccctcaagctagagttaagtgagcagacgcctgcatgccaagtaccatgctagagattttatgtatataatttctagtcctcccaacaagtttgctgcaagtttgatggcattacattagtgcttagacaaggaaactgaagctcagagagagcaaacagcaggtccagtgttagagaggcctctctttccccttatctaccatttgacaacactactctgaacactcctgcctggtgatccccatccacctggtgcctggatgctcccaggaacaaaatgctgtttacatacgagggcaactcatatttgggttgctacgttcttccttttactggagccaaaatctacctcctggcagagttcaccaactggctttcagttggcgctagttccatccctacgactccacaggacatgtcttaacccccttttaaaactgatagctcttttaatatctacacagagtttcaggaatcttcacttcctccggctaaaaaggctgggttctcttcaccactctttatttatattctagaaaggcagagaggctctcactataaagccacaaagacccatattcttcaacaaatatcatatagaatgctgggatgttatgcttaatgttgctgaagactcttaaagctgttgtatttatgcaactgcaggcacagacacaaatcaaaagatccattattcctcaaccatgcaagaaagcacaaagaggtcacagagtaaccatatctggggccaaggggaacccgtcttctgatgtttccaagataagccctctctggagaatgaaatgaattgtgtgctattaatgtgactgtacctttacaaataaccagccacagccccacagccttgggtcctggcatatagcactgaggtggaaaactaaaccttagaatcctgtgtattgacagcccacaggaatctctgaacccttgttttgaatgatggagatggagcttgccggcttcatccagaggatgtgagaatcttaccctgcagctccctggtccgggaccttgaggaaatccaggctctctggcgtctgtgacactcggtctgaactggtagactgctgccgaggcaagggcgggcgggccatggaggtgtacaggcttttctgattggacctctggcttccaggagcatggggatatggcacatactggtttctgatgactccgttctgatggtatcctagagagaggaacagagaaggaaataaggctcagatttttggatcctttgccaaaagtctctccacatttcttccatgtactacaagggcagcttacttaacttctgagtctcaatttccgcatttgaaaaaaatggaaggcatcactgctaacacattgtgagaattagagctgattccctgttttccccatcaccgggctttactgaggtataactgacaaataaaattgtatgtatttaacatgtacaacaatgcatggtcaacttcccgggatgtgcccggaacacagcggacactcagcacatgcttggtggcaatagaatccccagatttcctggggttcaaagcccacagtaaggtaagcttacagccggctgggagacaccttcttgggcctaagaaaaattatgagattatgactcaagagggctgacaggcagctgcttaaacagctggacatccattttcgaggggtcaatcttgggcatccacggcaggagcctgctgtgtgaggcagagggggtgctctacacaggcaagggaaaagtggccacccagttggatcagtccggatggagcaagctctctcagccaaacagcgatgtctagttaaaatcgcattagccaataagtaatgggttacagtggcaggctccaaaccatgcgtcttggcagactcgggcattagcattccatgctacgtatgaagaggcccttattcattctcccactgacagatctgggctgagtggagaaagagaacaagactcttcaaggcccactttggtgaaccctacctaaagacctcttccaaccaaattaagagaactctttggtaccagtgggatgacccttaggaaaggattaggggttcagttctggctctgcctctgagagctatactgatcatgagcaagagagttgatctttcatagtctcagttcttcatgaaagaaccacgagataggtccagaatctgcttggtggcttccagctccgacaagcattttctctatatccttattattgcagaaatatttcatgcccagtaataataggtggaattcttactttgaaccacggttttatcagggtggagctttcaagagggtggctcctcatccagccatgtctctagcaatttcctcccacaggccgtcagaccagatcagaactagacatttggggcaaacagctgctcttcatcttacctcattccctcagtgagtgagagctgaatgggctcccacagggtctggggatggggagggtagaaggaccctgcttgctgcctagggtcccaacaaaaggagaggggcatcttaggagtgtgacatgccctcgggatgtcacatggccagtgataaaagtggggtccccacaggggctgctccacatgctgctcgagatccccttgtccacgataaggtcagaaatgaagagtaagcatttagaaacgttcatggcagtttgacagatctatttcatgcctgttgcatcttataataagacattttggcttatattttatatgttttgaaaattccattcttctactaattcatttttattgtaacatacaaatacatggtttgtgacggactggaaattttttaaaaccccctgaaaactcctggtctttcaccacagacagtttgagaagtgctggtcaaatggatctggtcccattgtctcatttttttgatgaaggaactgtcatttagagagttggggagccctgctcaaggtcggaaactttgtggcctgatttgatctgaggctactttggccaacctagctgaggccagtgagctttccaggtggacttggccagaattctccactggaaccagcgcacacgcagtaatatgatactacagtgcttctcttaagttcctttgtgcttggattttcttcaaagaagaaaggaggagacagagccgggtcaaggcaggatggggactccaaaagagatgagaattagtttctcactgctgggccccagtgtccatactttagcatgcaatggtgagattccagagactaaagaaatgcccttttctggggggaaggtgggggtggatggggaggggagacagactctcactcagttacccaggctggagtacagtagtgcaatctcagatcacagcaacctctgcctccccggctcaaataatcttcatgtctcagccttgtgagtagctggaatcactggtgcatgccaccacgcccagctaatcttgagacagggtctcactctgttactcaggctggagtgcagtggcatgatcatagccacctcagcctcccacttcagcctcctgagtagctgggattccaggcatgtgccaccatgtccagctaatttttattttttaatttattttattatttatttatttttgagccagagtgttgctctgtcacccaggctagagtgcagtggtgtgatctcagctcactgcaatctccacctcccgggttcaagcaattctcgtgcctcatcctccccagtagctgggattacaggtgtgcaccaccatgcctggctaatttttgtatttttagtagagacagggttttgtcatgttggctaggctggtctcaaactcctggcctcaagtgatctgctcgtcttggtctcccaaagtgctgggattataggcatgagccactgcgcctggctgcagctaatttttaagaacatttttgtagagatggggttttgctgtgttgcccaggctgggctctaacttccggtctcaagcaagtctcctgccttggtctcccaaagtgttgggattacaggcgtaagccaccatgaccagcctcaagaaatgctttttactccttatcttggacattggtacaaatagaattctcttggctgggaagactggaatcaaatacagtctcaaaatgaccctatcagacttagaattctaaactgcttaataccaaacactctgggagtaattttttatgaactgaattttgtgagtgatggaaaaacattaaaagattttatgtatttttgcaagcattctgcaaacactacacagatttttagagacagaaaatcttagattcaggtttagagtgtctggatatgtcagttatatttttactattaaaaatgagaggccaggtgcagtggctcacactttcaatcccaacactttgggaggccaaggtgggatgactgcttgaacctaggagttcaagaccagcctgggcaacacagtgagactccgtgtctacaaagagtaaaaaaaaaaagagccaggtgtggtggtgcgtgcctgtagtcccagctactcaaggggctgaggtgggaggatcacttgatccagggaggctgaggctgcagtgagctatgatggcaccactgcactccagttgggcaactgagaccccatcccaaaaaaagaagagataaatatgaaatatgagcataaattttataacaattttgtaatactctcagatattactttgtttttttgaacaggcctcctgaatcctaatctcagaaaataaatagaaaacagatttcttctattcagtcattaagctgctataacttacaaaatagtagccccctcccctccttatccatgattttgctttccactgtttcagttacccatggtcaactgtggcctggaaatattaaattaaagttccaggaatgaacaattcctaaggcttaggttgtgtgccatctcaccctgtcccgccaggacacgaatcgtccctttgcccagcctatccatgctgtgtgtgctaccccatcatcagtcactaagcagccatcttgttattcataatggccccaggaagctggcaatttgggtatgccaaagagaagccattaagcgcttcctttaagtgaaagcgcttcctttaagtaaattcagtaacaatatatcttctatctgtaacactgtgaagacagaaaaaaatttctgctggttttgtggaaaactcaaactggaaaagtatagataggttttggtaatatctgcattttcaagcccccactgggcgtcttggaatgcatcccccgaggataagggggtgctgctgtagtggtatttggccggagctgggtagtggtggtggggttagacctgtaaactcctatttccataaagcagcatcctgtgtcttaaaagctgacaacagtctggttgttacggacaaggaactcctttctctctgtcagaagcctttcctaagggagtaatatttcgaggtaatgaaatccagattgcaaactcagccgcagttcagtctcactgactcctatttttctgaattttgaggtctcaagtagggctgctgtgttgtacatgtggcactgaaatggtccatgcctggttaatatgtgtgcattgatttgctaatgggtttcttcccaaacatattttataagttatgggtccagatttagtggtcccagactacggtacgtagctggcttacctgggggaggaggggcagctctcactgggtagttggcattttgagtcccactggaataacctgtattttgggtagtgttccttctggtaggacctgaaataaacaagacaaagttaaaaccagtgctactggttggttttatggatcctcatggttctttgcatatggaaaatttttgagaagcttggattccagctctcaggtggatctgcaggagaacagttgcagtggagaaggagccgttgagggaagtatgtaatggtagctattgggtgggaggggctggaggacagggttatagaggtacagttttgaaatgttagagacagtggttcttaaagaaggattggtcatcttacaaaggtgtttctatttttacagacttttaaaagagacagatggaacatttaaacatttgcattcatgttctaaatgctaagtggctgagcaggttcactaatgctgcggatcaacggggttggcatgaagcccgttctggcactgactgcacacctgcctacgtcaagcgccttgcacgcaagagtgtgtgttctacggtccttgaactaaacacagaccacaaggaggagaagcagacttgtacccttgacacagacatgaaggaatgaggaacaagctggggccaaaggaacacactgtgggtcacagtcagggctggacagcagggccagaggagccagaggagatctctgcagagacatctatgtggggaagaaaaacaatagggtcttgaatggaacaggaaggaaggtaggattaaaccagctggaagaggggtgcagagggaatttcttataaagagaagagctgaagaatagagaagggtaggaggtgacaaggtgcacagtgcaaacacagcaaaggagctgcagctctagggcctgggagaaccgaccacgtgggatcggggcaaacccagtgtggcctgctggacgcttccctcccagtacctaggccactctcgccaccccaaataagatagaatccaacacctattgggcaatttcccctcgggggcccgccgcacaaacatagcctgctggttatttgcagcctttctttgcccggctctgtgccctggggtctgagtcctgtggacagccaggcctctgccttccagtggggtgaggcctataggccaggccaacaggaggcactggaaggagactggagtgtcaggagggaggtgggggacttcatgtgcctccttcctgactgtagccttcagttcacctcgttcctccctctgctgcttcaggtttgcggataataatgatttcctgccactccctttccctgggtccctactttgttccctaaaccccgtccacatcttttcactgaaaaatcgcttcagaaatccctccaaaagttgctgtctgttttctgcaagtactaacggatacacagacatacatcaacattttctgagtggctctacatatataaagatatgatggcatttgctggtattgtattaatatgttagagaacatgttaaggtgtacctttgcagacagatttgagaaatggctaattaattaattaatttttgagatggagtttcgctcttgttgcccaggctggtgtgcaatggcgcgatctcagctcactgcaacctccacctcctgggttcaagcaattctcctgcctcagcctcccaagtagctgggactacaggcatacgccacaacacctggctagttttttgtatttagtagagactgggtgttggtcaggctggtctcaaactcctgacctcaggtagtccgcctgcctcggcctcccaaagtgcagggattataggcatgagccaccgtgcctggcctagaaacagttattttatataaggcatcttcatgtgtgtgatcacacacaggctaaatcttagaacaatatcacagtatatgcatacatagcatgtatgattattctatgctgtgtgctatagatataagtttataaatatcaattataaatacaaaaataaaggccagggaaggagttagactggggtttgaggtagtgcgtgtgtgtgtgtgtgtgtgtgtgtgtgtgtgtgtgtgtgtgtgtatggtgttttatttctttttcatcttcttttttttaatgaggcagggtcttgctctgtcacctaggctggggtgcagtggcaccccagtaaagatcatgatttactgcagccttgacctcccaggctcaagccatcctcccacctcagcctccggagtggctgggactacaggcatgcaccaccatgcctggctaatttttacatttttatttttgtgtgtggagacagggttttgccatgttactcaggctggtctggaactcttgggttcaagcgatcgtccggccttggcctcccaaggtgctgggattataggtgtgagccaccacgccgggcccagtcaatttctttaaaggtggcatagaggatgatgttggtattgtggacaagatctgactggaaagggaggggaaatttgaagctaacaaactttgatttgttttaaccacaatattgtaatgccaggtgtactgatacataagtactaagtccctcagaaacttttaacctgctcattttccttgctgttgctttagtttgaaatgttccattctgaagaaagcgtgagccccagcaagcagaaggtgtactgattctcagcccccacatctgtgcacatgtttgcagcatttgctcgggagactcgggggagcggcggcagttctgcctgcagggcccgtggagcacttacgggagttcttgggcagtccaggtccgatgctgacctgcagcactttgttactgggcttgaggacagccaggtccccaaacccttggtggaactgcacttgccgggagccccctgcactccaggggccccagttttcctttttcaacttcagttcaagcctgcaaaaagcacagtggggttaacaggtcgaaggacgcagtgagaaaacggtgctcagagatcccgccacggagttctgctgctggaaaagcataaacatgaggcgagaacggacaatctacaccaggagcagggccctgaggatgcgcaccgcatccatggggtggcactgtcgctgcatgacaatgagccagaaaaaggagcatctggggcccggtaccgtgagacaccaggtggtgagggaggtacatctggctaatgtgccagtgccactctgtcaggtggtctcagaggcgcctgctgaggggacagaggaaagagacaatttccaggtcataccgctgtgctgtcattgtgcttccagctgttgtccctgattctgtgcttgtggaggactgagagatgccagacacaggccagcttgaggactctagcatagaacctggctttgtttagtcctgtactattcttgcaccatcacagcccacccagggatggaaaaagacacacactagcaaccaaaatccaaatagaaggcaggatttacctgcaattcccaaactccccatccagttttaatgcttctatattgcatatatgcctgtattatgcaatccttattctgtttttaagttatattttctgatatcataagaaggaaaaatcataattttaagtagctgcctattataagtttccctcatcatgatataaaggctttgtcttggccttatttttgtagctaggaaaagatggaggatattcccattttatagatggggaaatttaaaaagaaaagctaaataactttctttctgtgttttagacagggtcttgctctgttgcccaggctggcgtgcagtggtgcggtctcagctcactgcaacctctgcctcctgggctcaagtatcctcccacctcagcctcccgagtagctgggactacaggcatgcaccaccatactcggctaattttttttttattttttactttttgtagagatgtggtcttactatattgcccagactagctaaataactcttactcagcaaatatgagattagagggtcaacagtatgccagccagtacctggtccattagatcatgttgccaaaagaaatgaaggtgaggctgggcatggtggctcaagcctgtgatcccagcactttgggacgccgaggcgggtggatcacttgaggttaggagttcaagaccagcctggccaacatggtgaaaccccgtatctactaaaaataagaaaacattagctgggtgtggtggtgagcacttgtaatcctagctactcaggaggctgaggcaggagaattgcttgaacctgggaggcagaggttgcagtgagccaaggtcgcaccactgtacgccagcctgggcaacagaacgagacgccatctcaagaaaaaaaaaagaaaaaaaaaaaaaaagaaagaaaggtgaaccacctacacaatacgttggccacctatagtcctcaagcccccggaggctctaccaataaacaggttttattatgcattggtttggggaatttaaacccccacctctgtcacttttatctgcttccagtgtgattctactcctgtctgctctcctaaattaaaaaaacccttttttgggtgatacataaaaatctgcctttgtctgcctcattcaggtgatttttgtctaaatgataaaatacactagtctatgaagtcattatttcacagaaatgcaaaagtaaccttttcaaagtctgtgactactatccagactgtcttctgcaggctctaaggttccactggggccagccagaccccactcttctcctcgcaggcctcctccagccccatcctgaatcgcaggggtgcgatcaagacccctttttagctacacgcagaagtctgggtcccagatccggacttacgtattgctgaatttcagaggtagttgcttctgggtcttctcctcgtaacgctttgctaagaggcttaggaattcagttttgaagacagattcaagcaaactgtcatactcttgctcatggagaataaaaatgtcatcctgcatagtactgtaaagagattggacaaacacacttggtgaaagctgtgcttctgtttactctattgttttttttttcttccattttaaaaatcctgcaagatagtgctaagattttacagtctttctttctataagtaataatctttcaaacaaaaccaacaacaatgaattacataatgaaattgctgaaatctgctttcaaagaaggtttatagtccaacaaaagcatgatcaaagtactttttccacatgatttttacaatcaggaacttaaggacaatttagcccatattaaaaaaaaatccattttcaagtccaacttgtgtttttaagatcataaaaatccagaaagttatgaatagaatgcagttgaaaagggatgactctacatttaagttccaagttagtataatttatgatatggttatagctattgtagtaaatttgaacttgaagaatcataagctcggttctcaagagggaagccaatatcctggacttcaaggtacttattaagaaccttctggcaaacagtgctctgtggacactgtaggccaggagctactagaacgtacagacacatccaagttcagaaatgcgaaggccagaatggacaaacagcaaacaagcaaaaatcatcaccttcaagctaatgaattttgtcagacaaggaaagaacacacctttgcgggaactgcatgtttggacagggtgggattgtggagaaatttatgcctggaggggagcaggtgttacaagctatagggtgatggcagagagacgctgaggcagacccagctccgaggaaacgcttgctggtcaggggaggttgatgagacaaagttccatcttcaagcctggctaggcttggtagaaagcaacaacatgtatgtaattgagaatttgcattccctgttagatttatcactcaggtgaatggggccaccaccccaaagactataatatataagtttacgagtatctccaagtaccactgccaaataccaaagacaaccctttgaagaatgagatttcgttagggattgtaagcattttcccaggcattagaaacaaattaggcaaacctgcttcagtgaattgaccatggtaacattttattctctccaagtgccacagacacggttctttgtatatccagagccctgcagcatcactcaggagctctgctctgctctcagagcacctggtgtcactgcaccagtgggattactgtggctgtgacaaagccagatgatgaggcaaggggatcacaagaggactgagctgtggagaatctttgagaccctggatccttcttccatgtaaaatctgatccatttagaaggaaactcctgtggtatccctgttcagccccattcacaggtcaaggtaggggttgggcccttcttggaatgacagggctcccttgggcagagaatcttgggggactatctcaggcttgtcaggaaccttctctccagactgagacagggagctagtgacccagaggtgatggagccagtagctgtagccacagcctctaccttggtctgatgttgaaactcattcaccaatgtgctagtattaagaagtgtggccttaaggaggtgattaagttacaaggaagaggtcctcatgaattggattagtgaccttacagaagaggtatgacagagtggtttgccctttctgtcattctcccatgtgaggacacaacaagaggcgccatctataaagaaaagactgggccttcaccagacaccacatctgcctgcaccttgaccttggacttcccggtctctagaactgtaaaaattaaattcttactgtttacatattacccactttcagtcctcctacaggaaaggggcttggtaatccacaggagaaaaagaggtcgaaggaaccacagcacaattggataggaaggcgtagaatggcagtacgcgcaaaccatgggggtggggcggggcggtgaatggagttcactggaagcaagaggccagtgtcaggggaaaggagcttggtcctttcatggccagcttactgaagagcagccaaagagtttcccttggacgtaaagtcagaaccctttacagtgttttttggacaaataatagccatttgggtggaacacttggtcattatcattacctcagatgtttgttttcagacatccacacatcatagccatgcttcttgcccactcctgtgatagttgggatcaaggataaaccctgacaagcagtggtttaaacaatagacggttttcatctccgtcactcaacagctcatgcaaaggcaattcagggccaacgtgccagttccatagtgcctgggaacaaacacctcctacttacctttaaaggtacagccagcaatctaaaaccccaaaaagcacttatgaaaagctgctcaaaagagctcttccaagtcattttgaattaataaagtctaagcctcctggcaccctagcccaggtgtaagaacccggctgcattaggtagagtgcatgcaaaagaccagagtaaaacaagaagctccactttttggcctttggggtgaggaatgaaacgccttcctgttttggttgtttgctcaaagctttctttggcatgtctggtcatgcctggtggcctggctgaactgtggcaggatggtgattattcaacagggctaaatgagcccaacacaagtcaccttgagtggtttaatgggcttagatttattaggagtttcattactattataacgaaaaaagcaagcaggccaaaacttcaaggtcaattatcagcatgaatctagaaatgagaagagatgtgtttggacactttgactttaaccaacaactccaaaatcccctcccttcaatgatccaggcattggagctaggcagaccaccttcacccaggccagggtctcagctcattctgctctccttagcccacgctcctgaacctgaaaacaaagctttcgtgtttatttattctaaaaagtcagacttatctttggacttcacccctgacttattcctatgctgcaattccttacagatgtttgacgctgtaagctgtgttgaaagacctcttcctagtctctggtttggatctgcccttgtttttttattcctctgtctttgcggcttactgttgtattgctgaaaacactagaaaatctgttttactctcttcaccaatatatcttttcacagaaatgttagttacaaaacaccaaggaaagtcctgaaggagttttgttttttttttttaaagctgaaaaggcaatttccaaggatagccctgcctttatttaagcttttataaaagtctttcctgattatgaaatatatgctgcttttaggaaactggaagatacggaggcgaatcaagaagaaaataaaccttgcccagaattctaccactcagagaaaccagtggcaccagtttcagaaccttcttaacttctctgagaaagcccggacgcagatgcaggcctcagcagtgacgtgtccagctcaaagaagcttcacctgacccgcagatgcaaagacccactctcctctcttgtgtcccaggaatatcctttaaatcacgctgggaacacttatagtaaggcacatgtttactcagctgtctgttcccccttccagaatgagaggagcttcctgaggcagtgactgtgcctcatccaccttcgaataccagggctcagcaccaggtaggtgctcaatcccatgatgttgacaacttccaggttcccaatgcttacagaccatagcaagtcaagatgccagtaatgcttcaggtcagcaggacaggcagtgaagcgggctgtttttattgccagaaagtttaggggattcaggcaaggagacattctgggcaagaatgttgtgaccagggagctggagcctctgtctaaaagcaccgtcttacgggttgtttttccaattggagataagtactggaaaatctattaacccagacagacagccacacaacttttggtctcatccttctggtgatcagccaccagaatgagaagaaaaatgagaagcctcatcagagacccccaaataagagcttccatggcaccgaactcaacacctacaatagcaaagccaagaacatgggtcattacacctgtggtcacccttcctgcaattgagtttttcaaataagagtggggccaggccagtacttgaacaagaagcaactctgggaggatccttcaaaaacccaggcatggccttctgccagcagccaccatacactcagaaatcccgtgtctcaactctgtattggtgtgtcacctcctgacactcttcccgagtctccaatgaagccagaaatgcaagcgtcagtgtttcactttaatttttatttatttatttattttgagacggagtctcgctctgttgcccaggctggagtgcagtggtgtgatcttggctcactgcaccctccgcctcctgggctcaagcgattctcctgccgcagcctcctaagtagctgggattacaggcacacaccaccatgctcaactaatttttttgtatttttagtagagagggggtttcatcatgttggccaggctggtcttgaacgcctgacctcaagcaatcggctcgcctcggcctcccaaagtgctgggattacaggtgtgagccaccacacccagcctaatttttatttaaataaggatttttcctgatcaaattatcctggagtccctttgacaaactattgtcttaatatctctctgagctattggccctatttctacctgttgggatcctattttttcttgtaaatgaaaacttcaaaaaaatttttaaccgtaactcaactagacatatatctgtatgtttagaaaagataaagacttctaaaaatttaacatctactggaggattagaaaaacattttattatggaaaattctaaattgtaaacaagtaggatagtagggccaggtgcagtggctcatgcctgtaatcctagcactttgggaggcgaggtgggtagatcccatgagcccaggaattggagaccagcctgggtaacatggggaaaccgtgtctctacaaaaaatacaaaaattagccagaagtgggggtacatgcctgtagtctcagatacttagggggctgaggtgggaggattgcttgaacctggagggcgaggctgcagtgagccgagattgcgccactgcactccagcctgggtggcaaagtgagaccccgtctcaaaaaaataaaaagtagtatagaatgaaccaccacatgtcagatttcaagcaccaattcacggataatcacaattatctacaacctcactctccctgcttccactttaaaataactaccaggctggagtgcagtggtatgatcatgactcattgcagccttgacctattgggctcaagcaatcctcccacctcagcttcctgagtagctgggaccacgggcacgtaccaccactcctggctaattttcacattttttgtagagatgggttcttactatgttgcccaggtgggtcccaaacctcctggggtcaagcgagcctcctgccttggtctcccaaagtgctgggattacaggcgtgggtcactgcgctcagcctttatttcatgctcaaatgtttcagtacatattattaaaagataaagtctctttatattaaaattaaccacaaaacattatcatacctacagaaataaacaataaattcttcataccaaatatttagtcatgctcacatgttgtcttgtaactgttactgaatggttggttggtttgaatagggagctgtaggcccactgtgcactgacattaattgtaagagctagagatgggctaagatcaagcttatgggatactttgataaatcgtaactaggaggccatatgttgatatcattccagccaatagtcaactggtcaatctcagaaattcttaaaaacacatacagatgttgcagcttttttcctgaagtacaagccaactgttaaaatctttctctatgccagtactgaagtattttgagaacacacacgcatgttcagtagtctggtaccagaattaatttccactctgggttcgattctgcacacacatcaccctctggttgctttcctaacttggttctgattactggcctaactcaagtataaagaaatgaggggacactattattcatcttggcaagtgtgaggttcagtgactgcaatacacagacatcacaagttcaaatgactcacactttctttttttttccttagagtcagaaaaacttttaggctaagtacctcattttactacagcctttaaaaaggaaagaccgcaagaaaggaaccttccagataatgaatactgaacaggaagaagaaaaagaagctggtgctcccatgacagattatatccccagaggctgtaaaagaagacaataaacaaacaaaaaacaataaaaggaagaaatttgagtgtgaacagtccctacagtccctgcttgacaaccccctcaaggacttatcaataagatagtaagtgtcaaagtgcttgatacaagtgtagctcaaggccaggcacggtggctcacgcctctaatcccagcactttgggaggctgagatgagtggatcacttgaagtcgggagttcaagacgagcctggccaacgtggtgaaaccttgtctctcactaaaaatacaaacattagccaggggtggtggctcaggcctgtaatcccagctactcgggagcctgaggcaggagaaccacttggaccagggaggcagaagttgcagtgagctgagatcacgccactgcactccagcctgggtgacagagcgagactctgtctaaaacaaaacaaaacaaaacaaaacaaaacaaccacacaaatgtagctcaattaggataatttatggtcccagtcatgagcactccaccaggggtctgagggactgaagacatacctgggcaataacagaaagaacaagtcactctcggcacagcgactacacacaccctagagctgtggttccctgactttcacctgctgtgcctgccaagcacgctgtggccaacctggcttagtccaggcatggcagggccccatgcaatgacaaacaaagcaggagcttcctgttgggtttccacggcagcctcagggcccagctagccaggaagagtgtggccagcaggcactgccccgctcaggttgggacccagccagtgagctgaatgtttaggaaggccttcagaaaatcagtcagcgcctagagctttaaaaaaaaaacaaaaaaaacaatagccttgaaacctacctgaggtggggctgcaaaatggacactgcggactcatctgcttagcaactttaccacatcctgagttggcacgttttaaatacttcactgcactgcactgcctggtcctttatccagggaaattaggaacagatagaatcagaaaccacagagacacaggcaagaatggatgcaactagaaatctgttttggattatcagactggaactaggatttccagcttggtacatcagacgcctgagcacataaaacccctgctttttcctgagcgcaccagttttgccttctgtgtggagtaagagtttgacaggcgtcccaattccatgttcatgtgagagcagaacatctttaatgcaaaggcccaaagcttttcctgattaaagtagtgttagcctcagaggcccagggacacgattcttggaggaagctatggggctcaaggaggcctttcttccattcttagtcttcatggattgcgaggatttcctgtgtcagcggaacttagtctaggagttcttaccatgggaggacttcgggaggacttagcatgggaggactcctagtctgggagttcttggcatgggaggacttcttagcatgggaagacctcctatgctaagaacccctagcctaggtcccactgacggaggagatgctgacggccggcagaggagcccttctgccgagaggaagccaaggtgctgccgggaggagcaagggcccttcctgaggccttgtggaagcaaacaccactccccactgcctgagaattggagcgaagagagcatctcacgatgactccagggctacagagaatggagaccaacttgcactccctaaggaagtcccaaagaaacttccctttcaggaccctctgctcagggaaatgggtgaggcctccaacctgggtgaggtggactgggggacagggctctgaatccttggctctactgcaacaagagaaattattctctgaggtgttccatataccgggttcatttctaacacgtttcggttacaagagatctgggtcccccttgattagaggagctgtccggaggcaaccttttcttggtaccttcttcctgacatatcaagacttgctgagactagggagtcttccctttgggacaaagggaaattccattctcttgatcatgattttgacagctgggaagcccagcccggccttcctcctggctgtttggaacagcggaccgtgatgctgaggcgagaaggggcagtcctgcctctgcacctccactactcacctgagggacacagacaagatccgttctatctcgattttccgcttcaggacttctttcaccaggcccttgtctgggccctgtttgactttttctcgtccgattaagtacaagcactttggggtaaggagcaggtctcgctttacaccctgtaaggagaggagctttaagaagctggacaggccaggcatggtggctcacacctgtaatcccagtactttcggaggccgaggcgggtgaatcacctgaggtcaggagttcgagaccagcctgaccaacatggtgaaaccccgtctctactgaaaatacaaaaattagctgggtgtggtggtgggcgcctgcaatcccagctacttgggaggctgaggcaggagaatcgctttaacctgggaggtggaggttgcagtgagccgagattgcgccattgcactccagcctgggtgacagagcaagactccgtctcaaaaaaaggtggacagacatggtcaatgtgatgacaacaattcacacagtggactgctgttaccaggacagggggaagctgccttggacagtcaatcttcactactgttgagaggccattccattcatcacatgaccgggccccatgacagtgaaagagggcattgttcatgattattaggatgacatgtaaaaaatgatgacatttgactctttttgacttaaaaactggcaaactcatatggagtcacttcacatatcaggacagcaggtgtaaagggaaagtcaccaacacctgtggtgaacttagcaaggatgcactacagcatgtttctaaacagggggcagtgtctgcatatattttcttgggagttcataaaattttcattctaaaatactgatatattgtcatttgaatgataattctcaataatctaatagaaatctacttgggaatttgtgggtaaccactttataatgagtaccgctgcgagagctaagcacccctgtgtgcatccagggctgccgtcacagcagctggtgccatgcacaggttgcaaggaatggtttggttttagcaaaacatgcttccgttgtttatttcgttaaatttttttcttgacctccccgcccctggcaaaaagccaaaagctcttaacgggtccatgagcttctgaagcttcagatttttctattaggaccaagactttatcaaaaggtatctaaaggaggaggtgaaaaatcaactgttcctcctgtggctggaaaagccttacttatcagccactctgggaaaatggatgaggatactctgcaatattacttgatactctgaatcctttgattcaacgatttcactcctatcaatttcttctaaaaatattaggagacagatagatacacaaagatgtgtgaaaagatgctcactgaagttacgatagtaaaaaagaaaaactcactaaaaattgattcatgagaaactggttaaaaataataaagcatctgtcaaatggaatactatgcagccatgtaaaataacttatattgctaactgtattactatcgaaaattctcgcattatttaaaagacaaacaaaaaaccacttcaggacataaaacagcatgtaatgtatatctcattttttgtaaaactaaatacgcaaatgtatgttttcataaaaacattctgaaagatatggatatacacagaatgttaacagtgaatgtttctgggcataggtgcctgtttatcttttggtttactgtattttctctaaatttttctacaacgaacacattctgatttggtaacaacaaaagcaaaataacaagttattaaaaaaataaggaatctgtttggtgatctcagaggcaggcagttagcacgtaccttgaacctcctgtcatacttggtgactgtgtctgcgaaatcaatcttctccctcttgcccacgaactgctggagttctgggtgctcttccatcccaatataatcccctataaagttcctgttaatactgtttctccttctctccttcttgttcaataagaggtctgaggctacaattcccaagagggtcaagatggaagaaggataagtcagtcagaaaagggaggaaaatactgtggaaatatacaaagaaactctaaatgatgcaatatttttagcgtgacattatatgcaaaataaaatggaacttaaaacttcacttaagctccaatttactcttcagatttattaaaatcaatgaaacaaaattgctaaaataccttcttctctcatttgaacgtatttcttccgggccacgaatttcctccatgatttctgtatcactcgagcatacccatcatactttctctctctcatctcttctaaaagaaatagctgtgaatggagagaagacaaatgtgagccaagccccaagccccaatccctgaacaacacttttcttgttattccagggaccctcagtttagacaatgacacacacgggaagcagcttctctgattcatgaacgaatatgtgaaacgcttactgtggcatgttgtttattctcactataaaatgacctatacctttttttcttttaatggaaaacaatgggaaataggagaatctgagtgtattcagttagaccttgtcctgccttgctacagtctctgtgagaatcgaatgagcgattcaatgcttctccacttattccccaccttgatccaaagagtgtattattaggaagtcagatcaagtgagtgggtggaggctgttgctgttgtttggcgcggcacttctgcatgcagcctctaaacagaattttccagtttctgcaggagctgggcttgtgctgctgtggaaggagggctgccctactttcagttccaagaaaatatagacttcctgtctcaggattcaccaatctcaggattcaccaaggaccagcggagcagaggataataaccacagtgactggagctggacgtgaggtgtgttaatgaggacttgcatttgcccagaaaggctggggctgtttagggaccacatcagcctctagcaggtcttgagagtccggccattttaccaatgaatgctgacagctgcgcctcaaccaggccttggaatgataaaggtgacagcaaacagctgtagtgagccgagtgcccactatggggcagaagtcaccctagatgatttccacacagtttcattcaacgcctccacagctacatgagccgcatactctgtcatctctattttacagatgagaacattggaactaagactgggtggggctagaaagtgaacctaggtctttcaggctctgccaggctcctcctcatttagacacgcaaagctttctctgtaaatctgcacttgatccacttgtaaaatagtaggaaaccttctcatttaccttgagagtggcttacatgactctctaggaaaaaaataaaatcaaccaataaaaatccaaagtaaagatgatgaacagtcattgcaaaaatgttccagaagtaaacaagccaatgtggtttgaaggcagctgggcttgatttgttgtctctgtttatccgggtgcatgcttgggagacagacctatcctctcctgccactcaacttctctcctcacagatccatctgtgcagaaacaacaactcaaactccaaacaccaggggagggaccacgtaattcccctggcttcagtgctgtaaacaataggcataaggacagatttctaaaccccaagtggaatgcacagattagcaactggacagaatgtttaaaatctgagccctgcagttgcctgttgtaagaatatccattgatatttcttatcttgtgtattgggtttctgagtaagtcttgtttccttcttctttcccagaactattttgggcgtatcacagaaaatacacttgtgactcagagaaaggatgaacaggcaaacgattcccaacttcctagagactatctcaaagattcgctggattttagatttctttttaaaagcccagggggttagaaattagggaggttcaagaaaaaaccttgataacacagataaggagagaataaaaaccaaaccaaaccaaaaaacaacaacaggaaaacacacaaaacaaccttaaatgagaaaagccaaaagacatggatacatttaacaaaacaaaaacaaaccctatggtgtctgatgtgggttttgttgttgttgttgttgttttccgaggcagagtcttgctctgtcacccaggctggagtgcagtggcgcgatctcggcccactgcaagctctgcctcctgggttcacgccattctcctgcctcagccacctgagtagctgggactacaggcgcccgccaccatgcccggctaattttttttgtatttttagtagagatggggtttcgccgtgttagccaggatggtcttgatctcctgacctcgtgatctgccggcctcagccccccaaagtgctgggattacaggcgtgagccactgcgcgcggttatgatgtgggttcttaaagcaaataggtaattttgtatattcagaacatttactattaaggtgaaaccacatggtaggttttctttttccttttttttttttttttcttttttttagagaaagggtctttcttgatctgttgcccaggctggactgcagtggtacaatcatagctcactgtaaccttgaactcctgggctcaagtgatcctccaacctcagcctcctgagtagctaggacagcaggcgtgtaccaccacacccagctaattttaaatttttttgtagagaagaggtctaactgacttgcccagtcttgaactcctggcctcaagtcatcttcccaactcagcctcccaaagtattgagattagaggcatgagccactgtgcccagccagattttaagagtcaacttttgtgaaagtatttgcatgtcagggctagatggggatgtatgcgtttggggcaggggagagagcggaggtgatggtgtgcgtgtgtgagtgcatgtgtcaaagatgggggaaaggagagtcaaataatggtaataacacaattgaatgtaaggcaaggaaaaggacagccaaaaataaatcttgattttgaatataaccccctccaacgcaactgaagcagaaaaaaaagtattacaaatattgaggctgttttaattatatatgaaaacctcacaagttgaaaagtaacagcgggtatgaaacaaggagttctgcattgtaccgataaatcactccatcccattttagaaagaacaggaactgttctgtgggttgcttaatggcgaatgacacaacattttcactttatatttggaaatgaaaattcttgtgaagctacaaataactcaaagtagaaaaatgctaccacaaacgtgtcataaatgggttccatctctgtgtgccgcttatttaataatcttgatgtctcacaaagccattcagttatagccattatcattcctgagtctcaggctgatcctacgaggcaggcagaaacagtggctatggggcccaccttagaggagaagaaaactaatggcaagactgggatctgcctgaagtcaaatgcttccctttttactgtgagttcccatatgatttccccttggtctgatgactgatttctgccaagttcatcactgactcttgaaataggtcttgtgatggttaagggagccttgagaaacgatgatgctgagcctcggttccagcagtttctccagcttaaaaaggaatgaatgtctttattccgcagccctggagcaaactgggcagaagaactgaacagaacttcctgtggacattcatggggctcactgaccacactctcatcaggaaagaaagaagtgtctctaaatgaagctgtagcagactgtttgtgaattgtaaatgtgtattatgaatgccttactggtaagtactgtgttctataaaccagagatttctcctcccacctattttccccctcacagtcctttctaggctcccccacagccttctaggtacaatcctgggaattcccacccggcactctgctgcaccttccaggaggaatcctgagactatgcgtaactgacttggtgtcaactaaccatgggtgggacactgaagtccctctttagcttagacactcttagagattaagtaactattgagcattttctgtgtgaggctttgggtatataaacacatatggaacaaagagtccctgccctccaggagtgtagcagctagagaggagcgagacagtcagcgaggaaggagccactctctgatgcccctttttctacctgcttagtgctctgcaggaaatgaaccgggcagtgatgggctatggagagcaggtgtttagggaaggacccacttagaccaggaagggagggaaggcttctttgaggagacaacattgatggcatgaagcgaagaatgagaaaaagaagccagctgaggggtggagcagggctggcgggggccccgcgggagggaagagagtggagagccagccaagcactcacagactcgggggctttgatgaacactttactcctccccagctggaactggtcgctgtccatgttgaccgactgcagcaggtgcaggacgccttgcttctcctctccctgccaagaaggccaggtggctttggtcagaatggcatacctgtggggacattggggagaagagaatcacacttgggcgggaccgcactggttttctacccgggcaaggcagcaagagctctgctctgaaggtgcccagtgctgcaaagttactgatcatctgtttaccagcgttcgaaggctcaggcgtggactgcgatgactgcaaaaatcccgagtctgggatgctcgttcccgagctgcctcctgcttctttccctttcccagcattcccacgtcaacaccctggtgaaaacctgcgtactctttctaccactgtctgaaaatagcattgtggaaggccaccaggggtggtctttaggcaaaaatcaaacggtcttgtctcaataatcatctcccctgacttcttcagggcatttaacacttaatgcaaagagttttataaagctcctgctaaacagctattatgacaactgtgtatcaactttcacctttgaaattctgtgcatctgggtcacgaggcccttgggatctggtcgttggctgttctccagcctcgcctcttcattctcactttggcttgctgcatttcttcgagaatggcctcttcttcatgcccaccatgccctttccttcctcggcgcctctgcccctgctctcccctctactggtgtgctgctccccaaactcatcactcggctggctcccgcttgggtgtctcaccttcagtgacactcccagacaggccttcttggaccaaaaatcaaaaactgctctcttgttagtttctctcatagcaagtactatttttccttcagagcatgtactctaattggtagttatattcacggtggtgtttatttggttaatttatgcctcccagatgaaggtgagagctccaggagaccggatgccacatctgtgtggctcctgctgtacatccagagccttaaaccgtgcctggcacacagcagtcataatgaacattcctggctaatgcggatgggtgctctctctgcatgaggtgctgtgattgaagcttttgatgtacgatctcctcttactcctacagcaacctgatcaggttggttttccattttgcagagtaggagacagaggcaaattatgacttgcccaaggctacttagccattaagcgtcagagatgggatttgaatccctctctgtctctttcatgatggcactgtaaaaaagccatggactggttcacatttaaatatttcttttaaagattatccagtctactatacatgcctatgttagaaacattactattatgtcagaggctgatataatcaaggagagacaaacacattacagtttgtcaaatatggatagaatcatcatgggtatgtgtgggtgtgaagttggagggcgtggcccacgtgagagcacatccagggcccaggcaataggcccccaggccttgagcgaagccagggccctcctttgttcccagaaactactgtcacgattagactgatttatgacagccaagggagaagggaaccttgagtggccctgccagctggttgcgactcaggtgattttaggagccttctctgctcctctcaaatgtctgcatcttgcctgataatatcataaacttcctagagaggtaaatcctcctattccctaattagagataaaaagcttaaaaatgaaaatgcctagtggaagtcacacattagcatgaataacattcatatatgttataaggatgttaattaaaacaaattaagctacacataaatgactaatagcagaacctgtctagatgtgattgggggagttagtgaaaatgagtaggtgctaggaatctaattgggtgaggcagaaagttcatggagggtagaagtgagaaggaaaagactatagactttcaaggtgacaagcttctgagagtacagttttgcttggcttgatctaacctaaaattataaactaaagtatatttatcgtgcaactggaaatgggtctttatggcaattcacattttttcctacaaaattaatgctgcgtttctctttttttttttttaatggtaacgaaccttgcagagactttctctcccttatcctgacaaggcctccagtgttgagggtcttggcaatacatgggaattgcctggggcttcctttgcttccatgaagcctgatacatcctcaccccatcctttggtatcgcactggagaccagggcataaaccaacaacacatgttctcctaccaagtgtacccaggccactctctttctctaggatatactcatgggaacaggttgcacagggcaatggtgcccctgcctaactggtgcctgtgataattttggacagatggcaataatagcttacattcctttcatcacatattttcagtttaagactcaaatatgctaatatttcctctcaaggcctttgtgccagctcctctttctgcctggaaatctgttccctgctcttgttatctcttggatcactgatcccatgtttccttctcagaggaaatgcagctgggaccccagggactcccagctgctggcacttgagattaaggatgtttctgacctcggaggacacaaacatcctggcagccaggagaacgctctccaccactccgtgctttcctgggcttcctattcctccttctctcttgcccgtgaagtggaacgcctttgctgatgaggcatccctttatcatccccacattctgagaggctaaggtcagaggaagcatgcttgtgaggaagtgtaaatcatgctacaagatagactttgcaaatctgttatgtttctaccacattcttcctcctaagcatcagaatctgtatttgggcttatttctgccaaccacagaaagaaacacacattgcctagctcagagaggtgttttctggagaacttattttccaagacacaacatggctatttgtaacagttttttaacactttctgaaggcataaaagttgtagtggggagatggtgtaaatgggttcttcctactactgcttcaagtagcacagcacttacttcaagagcatggggcccacccatgggggaattaaggcatcttttgatttttgctctccaatattcagtcaagagggatggttttgataaatataaaggattttccagagaggaaacgaacacacactaaacacacagaatatttcctaagcaaacactatgctctgggtagtctgtgagccatggctctgtttaggcctgtgaacttcctatatagggagggtgtataatacatgcagatgtggatagttgtgctgggtattaatatatcctttcccttcaggcttttactttctgtttctcatttggcagcctttctgtggacacctagagagcaattttataaacaaagcctttcctctcacctttagagaaaataaagttatgagatggttcaattacttgtagagcatcataggatgagacagttggcggtggactctggatgaattctgcatgaccaagatcccagactcatgcgtcttatggaaaattgtgttctctccagagaaatacccccgcccactgatatagtgggacttcaagccacttttgagtggactgcttcaataacagttttgaaatatagtgtgggggattgaaaatgtcctttttatagaaaaataatttctttccaaactttgattctcctcccagtattctttttttttatttttatttttgagatggagttccactcttgtcgcccaggctggagtgcagtggcgcagtcttggttcactgcaacctgcgcctcccgggttcaagcgattctcctgcctcagccttctgagtagctgggactacaggcacccggcaccatgcctggctaatttttgtatttttagtagaggcggggtttcaccattttggtcaggctggtcctgaactcctgatctgaggtgatctgcccactgcggcctcccaaagtgctgcgattataggcattgagccatcttgcccagccccagtattctcaaaccaagaaaagtatgacaacaataaaagagcctactttttgacaatagagacaaggctatttgtctgttctgaaaggaaaagcttacagcaggagagctaagggaggcatccaaggatacaagcatttcagtggaagttcctcaacataaaaggaataacaaatttcacaaaatgcctactcagagtgcggcacagcgtaaagtacagcatggaatcatgaagctggcatggcactcgagacagatccggataatcaacagagtcagttcacacctcatgcacgtatcacagggtcccttacaccagccaatctttttggcaccaggattcatggaagataatttttctatggacggggttgtggggatggttttgggatgaaactgttccacctcaggtcatcaggcattagattctcaaaaggagcgcacaagctagatccctcgcacgtgcagttcacaatagggtttgtgctcctatgagaatctaatgccaccgctgatctgacaggaggtggggctcaggcggtaatgctcgctggcctgctgctcacctcctactgtaaggcccagttcctaacaggccacagaccagtactggtcccctgctgcgagttggggacccctgccttagacgggaaaaaagagtgcatagacttcctgctctcctgagatggcagcactctcagcattgtttatggaagtcagtttggttggttggttggtttttaaaacaaggtagaaggaaggaggtctttcagaactggtttctcaaaaaacaaacaaaaaaacccagaatagattaaaaaaggtttgatcaggttttttttttttttcttgttttcttgagacacagtcttgctctgtcacccaggctaactcactgtggccttgacctcctgggctcgagtaatcctcctgcctcagcctcccagtgttctgggattacaggcatgagccactgcacctggactgataagttttttttggggggtggatacatagtaggtatacatatttatgggttgcatgagattttttttcttttttactttttgcatgagatgttttgatacaggcatgcaatgtggaataaccacatcatggaaaatggggtgtccatctcctcaaacatttattctttgtgttatatgaaatccaactatactcttttagttgttttaaaatgtacagttaaattatatttgactatagtcacccagttgtgctaggaaacactaggtcttactcattctttctatttttttgtatgcattaaccatctgcacctcccttccccttcccccactacccttcccagcctctggtaaccatcattttattctctatcttgatgagctcaattattttaatttttagctcccacaaataagtgagaacatgtgatgtttgtctttctgtgcctggtttgtttcacttaacataatgatctccaattccatcgtgttgttgcaaatgacaggatctcattctttttctgagacggaatctcgttctgtcacccaggcttgagggcagtggcgtaatctcggctcactgcaacctctgccttgggttccagcaatcctttcacctcagcctcccgagtatctggaattacgggtgtgcgccaccacacctggctaatttttgtatttttagtagagatgaggtttcaccatgttggccaggctggtctcaaactcccgacctcaagtgatccacacaccttggcctcccaaagtgctgggataacaggtgggagccactgcgcctggcctggatctcattattttttatgcctgaatagtactccactgtgtatgtgtaacacattttcttttttttgagacacagtcttgctccattgcctaggttgtatgtagtacagtggcaaaatcttcactcactgcagcctctgcctcccgagttcaagcaattttcccgcctcagcctcccaagtagctggcattacaggcatgggacaccacacttggctaagttttgtatttttagtagagacagggtttcaccacgttggccaggctgatctcgaacttgtgatctcaagtgatctgcctaccttgacctcccaaagtgctaggattacaggtgtgagccactgcacccagcctgtatcacattttctttatccatttgtctgttgatggatgcagcttacttccaaatcttggctattgtgaatagtgctgccataaacacaggcgtgaacatatctctttgatatcctgatttcctttcttttggctccatacctaggagtgggcttgctggatcatatggtagctctatttttagtttttggaggaacttccaaactattccccatagtagttatactaatttacattcccaccaacagcatacgatggttccctttctccacattctcgccagcatttgttattgcctgtcttttgggtaaaagccattttaactgaggtgagatatcgcactgtagttttattttggctttctctgatgatcaatgatattgaacacgttttcatatgcctgtctgccatcagcatgtcttttttttgagaaatgtctcttgagatcttttgctcatttttttgattggattattagattttttccccacaaagttgtttgagctccttctatattctggttattaatcccttgtcggatggtttgcaaagattttctcccattttgtgggttgtctcttcattttgtggattgtttcctttgctgtgtggaattttttttttgagatggagtctcactctgtcgcccaggctggagtgcaatggcgccatgccaactcactgcaacttccatctccctggttcaagcaattctcctgcctcagcctcccaggcagctgggattacagatgcatgccactgcacctggctaatttttgtatttttagtagagacaggtttcaccatgttggccaggctggtctcaaactcctgacctcaggtgatatgcccacctcggcctcccaaagtgctgggattataggtgtgagccaccgtgcccggcccctcttaattaaaaaagggtattttggggtcgggcatggtagctgatgcctgtaatcccagcagtttgggaggctaaggcaggaggactgcttaagcccaagagttcaagaccagcctgggcaaccaagggagaccttatctctaaaataaataaataaataaaatttaaaaatgattatctaagccaaagttcctcaactgactgtgccctgtagggggaacattagtcaatgcctggatacgcttttggatgtcacaactcagaggaaggtacactactggcatctagtgggtggaggccaagaaggctgctaaacatcccacaatacacaggacagacttcgcagcaaagaatcttccagcctaaaatgtcagtggtctgaggttgagaaaaccttttctgagctagtgttactgatctgtttaaggaagtctcataactaacatctcagttgtgtgtcagcaaatgggtggtgctatgtgatgcaaaagctctacaaataccttttctcaacttcctaaatatttctttcacatagtcctgcttacactataggcgtactgacgtctttaattcagagaacaaagagggtaaaccttgttcctagtctaactcacctccacggttattaggaaactcaaatgtgggggactgagtttctgacgctttattatacaaaatcattagctcttttttaaaacctctaaatggtgagtcggctgtcctaatctcatagcagaagaaacaacagccctaaataagaactgtcttattagaaatactagattccaaagacagtaattaacttcttcttcagttatatacaatctgaattttaaaaaaaaaaacattatatccagcccctgcataatatatcaggaagatgtaattgtttctgattaaaatgctcagtttgacgcggtgtggtcgctcgtgctgataatcccaacactttgggaggttgaggtgggaggatcacttgagagtagctggggcaacatagcgagaccctgtctctacgaaaagtaaaaagtcatctgggcatggtgatgcatgcctgtagtactagctacttgcagactgaggtgggagagaatggcttgagcccaggagttcaaagatgcagtgagttatgattgcaccactgcactcctgagtaatagagcaagactttgtctctaaataaataaataaaacactacatttggcttacttcttttttgtttccctattccttcaaggaaattaaatagatgtagaaatacagtggaacgccacagaatcattagagaagttagagtgatgtaacattttaagggtaccacattttatccttttacaaacaacacaaaataagaacaatttaagtataggtcctgccaaatacatgttaagggatatataaaaataagtttaaatttatacatggattgtacaaaatttttgaggttaaatattttaagcttattgtcttaagtgggttaaacattttcctgaaattgtcttcatactgttaatttattcagtcaagttaaacctccgctcttcctgtggcacaattatcaagaattcttgcacttatgtgttacactaaacagacagcctaatgaatacttatggctactgatttattctacaataaataacagtaaaagaattattattacaatgcaatgataaaaagacaaaacacccaattaaaaaatggcaaagggcctcacagacatttctccaaagaggaaatacaaatggctaacaggcacatgaaaaaatcctcaatataatttgccatctgggaaatgcaaatcaaaaccatcatgaaataccactccacactcactaggatggttagaaaataacttatgttggcaaggatttagataaattggaagcctcaaatactgctggtggtacaaaatgtgaagtggtgcagccacttcagaaaacaatcaggcagttcctctcaaaggttaaatgcagagttaccatatgaccaagcaattgcactttgaagcatatacccgaaagaaatgaaatatgaccacataaaaacttgtacacagattttcatagcagcattattcataatagccaagaagtggaaacaactgacgtttatcaactgatgaatgcataagtaaactgtggtatatccacacaatggaatattattctgcaattaacaggaaggaagcatggaaatgcaacaacatggatgaatcttatgttcagtgaaagaagtcagtcacagaggacacatatatgattccattgctatgaaaagcataggcaaatctatagacagaaggtagataagtgactgactgggcccagaggcaaggggagaattggaggttgacaacaaagggaagcgtgatttcttttcagggtaagaaaatgtcctaaaattaacggtggtgatagttgcacaactctgtgaatacgttaaaagccattgactcgtacgcttgaagtgggtgaattgtatagatttgaattatagctcaataaacctgttttaaaaaaggccagagtcactagttcattacctctgtaggaatttttggaagatgcgccgataggcatagccagctcttctcactcgaatgttctctttcagacccaaatattcgacttgatgctttaccctgtgcaaaggagaaaatggggcctggacattactggataatcctttcactcgtgttcttaccagccaacccccaagcccccagttccaagctgtagggaaacatattcagaagactacaatttatagtgttcaaacactgagctgacctctcagatgacataatgctaatttttaaatattgaaatacagcaattaggctgggcgcagtggctcacacctgtaattccagcactttgggagggtgaggcgggtagatcacctgaggtcaggagttcaagaccagcctggccaacatggtgaaaccctgtctctattaaaaataaaaaaattagccaggcatggtggcacgcacctgtagtcccagctactcgggaggctgaggcaggaaaatcgcttgaaccagggaggcagaggctgcagtgagctgagattgcaccactgcactccagcctgcatgacagagtgagactccgtctcagaaataaaataaatataaataaataaataaataaaaatacagcaattaaataacagggcattacatatctatttcaaagaataacagtaacacaaagacccatctatcacctagagtatgaacaaaaatattggttaatcagaaggctaaaggaaagaacttttaacttttgaattaaatgatgctaatgctggttttgttattgaacttaaattttaatattgattatgacttaatggaactacacttctaggcttttctaatacaagttacaaaagggcatttaaaactattaatttcaagtgtgtacattaaaaatggtctaaaatatatctaaattatagttttagttgatttcttctttcttacaagaatttttttttgatacagggtctcactttgtcatccaggctacattgtagtgatgtgatagctcactgcagccttgacctccccaggctcaggtgatcctcctatttcaggctcctgcgcagttgggactacaagcatgcaccaccacacctggctaatttttgtattttttggagagacagggtttcgccactttgcccaggctggtctcaaactcctgaactcaattatctgcctgctttagcctcccaaagttctgggattataggcatgagccactgtactcggcgtgtttcttcctttcctttcccttcactttcccttcccttttctttctttctttccctttccctttcctttctttctttcgagacagagtctcgctttgtcatccaggctggagtggagtggcaaactttctttcctttctttttcttttctttctttctttcttgagtcagagtctcactttgtcatccaggctggagtgcagtggcaaactttctttcttttctttctttcttgagacagagtcttgctttgtcatctaggctggagtgcagtggcaaaatctcggctctctgcaaactccgccttgtgggttcaagagattctcctgcctcagcatctcgaatagctggaattacaggcatgtgccaccatgcctgggtaattttttgtcttttttcgtagagacggggtttcgccatgttggccaggctggtctcgaactcctggcctcaggtgatccaccacgcctggcccatcctggtttcttaacagtaaaaatctagcaatgtcttttgaaaaaatggatgtaaagaactattaggttaatattctcacacatgaggattttcataccagaagatgccccatgccccacaccttggggatgctgatttagtaggcctgcaccttggggaggctattttagtacacctgctgggtctaaggtggagcacggacatgtgccttgtgaaaacccaccacttgctggaaaacacagtgctctggatgccgacagatcctgaaaacttgcttcagatcatccactctgggaagataaattgggcctgggctgcgtgctgcgcgagctggctgaaccagacacttggaaacatggtatttgaggcaaattagacataaaaagtaaggtctctctctttcgaagatggaatgtcaggattgtgctgcagtagggaggtaactcctcacactccctgtttggtacatttggggatatctgtgctgataacggggctaatgcgctcagcaaaatgggcctttcaggagctgctgagctgaaaagacaatcagaagcatcctcattccgatgtcacgcaggttcccaacagctgtcttcccagtaaggctctcacaaaaaccaccatttccaattaagtctcatacttgcggatgtctactgtgggccagtcacacacagtgcctattgcaacatgctagggtcaccaaaaaaggacaatgctatgattcctgctggagcccacacaggcagcacagtggttaggagccaggttctggtgctgcattcctgctgcgccactggccctgccacgatgcaacttctctgtgcctctcagtttcctcttctgtaaaaacaggaatggtggcataaattctttatttctagacgagtactttctatggaaagcacttagttcgtagcacgagcatgtaaagctgttattatcgtcatccattcccagctacaatatgtaaaccaggataggagaatagagaaggaagtggatttttcacagcacagggattctcaggagcactgtgatgtgcctgggcctggaggggcgagttgaatccatgaggtatacaggacaaggcagagggctgtgaaagcaaaggtacaagaataggaaaggccagtggcagggtgctgtgggacaggaggagggggacagatgaagctcgaagtgggggtgcaaccttggctgatgggaaggatgtcacaatgggagtggtgtttaagagtctccagtttgatgggtcttacagagccaagagccagaaatgttgattcctctaagattattaactttcagaaagcctctgtgtgcaaagagttaagccgggcatagtggctcacgcttgtaatcccagcactttgggaggccgaggcgggcaaatcatgaggtcaggagttcgagaccagcctggccaacacagtgaaaccccgtctgtactaaatatccacctttgcccatataagtcagacagacagagacagagagagagagagagagagagagagagagagagagaaagaaatgtcatgtcaattaaaaaggtaattaaattgaaaaataattaattttcctttctctcaccctccaaatctaaaactcgccactggccttttctctagtgagaaaaatgcatgaaaaatgcatttaaaggttctgctcattttaaagtacttttcataaacactggcttcacgccaagctttcgaggcagggaatgcatcacccattaattcaagcagaaacgttcctctcccatgaatcacataggaaggaatattcctcatgttaaaacattgtttcattcattataacttccaccatcaggaaattttctggtagaaatgagtctagcaagtcctgtaatgtttaaaatttgggggtcatcaaagcgacacaagttgatttttgcatattcctggagcactgtcacctcctcagtagtcgttgatcagacaatgcccagttgttccctaggctatgccaactccatcttgcagagggagtctttttccaagactgtccctggccgtttactcaaattgatcagggctagagaactctgcaaggcagcaattcagaatgcagggcaagcaaccttgccagaagccaaacaaaaacgcatttgcaacaggaaaagaaaaaccctacacctcataaacttgtggaatgagtaaccctctttaccaggagcttcaactgggtgtgtaatcccagccagtgaagcacactgccctttcacggaccctaacactcctgactcatggatggagtgaaaccatttgttacacaataaacccaaaccaggattaagggtggaatcccagaaagcggtcttactggaattataaatcaacgctcgaccaactaataccttgaacttcttaaaaccagtttatttgaatgcatgtcataaaattctttgctgcaattcaaaggggaatcatttaaaaaaaaaaaaaagaaaagagaaaataccatcctcatcctatgaggatttactgaataaaatgtaccactcatttaatttctccattttctgatattccaatgaattatgttggatttttacaaggaagtagcatcagggttggtgaacttccaagcagctattgcaaaatttctattttagaggggctttcagtagaactatctacgtggggtagaggagggtgtgctagggggcattgatcagacaatgcccagttgttccctaggctatgccaactccgtcttgcagagggagtctttttccaagactgtcaaaatgcatttgtagggcaagtgagatgttttcatttaagagtatttgctgggaagagcaggtggatagagtttgaaatgggggaaggtgggctaaggccccctttggcaatacctctgcttccaagactctcatggtttatttctaaggttgactaaagatttggttggagtaatcatattgggatattgatttaatatcactgttctgttgtgtgtgtgtacatgtggatgtatgtgtgggtgggtgtacaagtgtgggtatgtgtgagaggtgagtgtaaaagtgacagagacagaggcagactgacagccactgtctggaagccttcattctgtcagactgaaggagatcctattctagatggaccctcttaagaggaaggaactgagggctaaggagatgaagagtctcgctctaacaacttagtgataggtcagcaccgggacacagtctagttctttgctctagatcagtgattctcaaagtgcagtgcctgggccatcatcaccagcaccacctgcaagatttttaagatgcacattcatgggccccacctgagacccactgcatcagaaactcgggatggagcccagcaatctcagctttaacaaggcctcctggggatcctgaggcaggctcaagtatgggaaccaatgtaagagagcaaaacaagatgttttctgtatgattgattgattgattgacttggggtctcactctaacagctgggctggagtgcagtggctcaatcatggctctctgcagcctcaaactcctgggtgtaagcattttacatctttagaggagaagagatgacaatgctgctaccctcttagtctgaaaggagaagcggaactatacatttcagaaaagcagaggccaaattaagtacctccaagagaagggctaagatggggaatgcttatatttcatgtcctagagaaactgttgacggaactgagagggattaacctgtagaagagaagattcaagagaaacacgacggtcacctcgaactaacagaaaaggtgtccagtggcaaagtaatgagaatgattcttatcgcagattgaaaacctgggattaggataaaagtgacctagagaaggactgtacagcctcctaaagtaagaattgaccaaagaagagctggtcaccttagcaagtatgagctcctcatccgggcctgaatatcattaacggacaatattgtagaaggaatctgactacattaaattgaaaaatttcagagattcaatagaaaagatgccttaagcggtcaggggtggtggctcacacctgtaatcccagcactttgggaggccgaggcagttggatcacgaagtcaggagttcaaaaccagcctggtcaagatggtgaaaccccatctctactaaaaatatagaagtagccaggcatgatggtgggcacctgtaatctcaactactcaggaggctgaggcaggagaatcactggaaaccgggaggcagaggttgcagtgaaccaagatcatgccgctgcactccagcctgggtgacagagcgagactcttgtctccaaaaaaaaaaaaaatccttaagaatatgcatctatggatgagattattcagaacatagtggcctgaaaagatggcagctcttacatccaagcagcctggcttcttcagaggagagaacagacttagactgcatgccgaagtattcaatattaaatagaacgaactttcagacagtaaatgtttgacctacgtgtttttcttactatggatctgtttcctcctgtaaaggatcaggcatcatctatctgccatggtttaggatcttactggcaggaaggaaaatggacacacctgtccctcgcaggagataatcggcagctaggaattttagtccttgtcttcctgtggaagctaaacctggagttcttcactcgacacctaaaagagcctaccttcttttctccaagagagaagacaagaggtagcaattctggtaggctcccatcctgggactgatactaggtgacgatggctagggtcctctctgtagtttaagtctctccctccttcccatgcttctatggacagtgggatcaggcctctgaacaatgtgtgtctgggtctcccagcgggccacaaaattcataccctctagccaccaccttaacaggctcctcctcaatgccgccatttcttcctgcccaggccacttccctaaatcctagctgtgggaggaacagtgatgcaggcttcactggaagtcagggcagaaagggtttgctgaattcttgtgctctgcatttccctttgacatctttcctcccagagtcgttcttctcatcaatacggtgcttagggggaatgccagagcctccagcttgtccccagtgtcttcacgaggcacagcaaatgctggattgtatttccatcagctcttacgccctccactttccaccccaagctaagcattctaggccacatcctgtgggtcccgatcaggggctgggtggactaagaatgtctacacagaacctcaaactgattttaaaaccatcatgactctgcggtatgaggttatgttttgttttttttccatctgcccccagactagccaagatcaacattataaactgctaatgctgaaatgaatggcactgctaacattttagcaaatgacacggaggggaaacagtatacagcttttgtcctgaaaaagttaagatgcaagggcatgacaaagacatgtgcggacaactgacactgctcctgcctgtgatggaggacggctcatcttgagcagagggaaaaaggtcccggccccacctaagccggtttcccccgatacctgctttcctcccagtctctgggcttcttggtttcgtttggcttgatgcagcgaatgtagtggggcgtacatttcatcagggtgctcacaaggtcattggcttgtttctagaaaggaagaacagtatcagaatcatggaactttctctaaagaagaccaaatttcaaaggagacttgtaaaactctcttgtagaaatacatagctaggaattaatcttcatgacaatttgctcgttaagcataactcaggtctactaaactttccgaaagctttgccgacttttatgatgattttatcactcctaaatgggtttgaaattcaatcttcaaaagcaactaggcattttcagtacagttaataaaatagaacaacaacaaaaaacaaaaatcccaataaatcttcacatacaaaatgattttcaggtggtacagtgaagcatgtcagttaacaaactaagttcattttatgctgatagagcgcctttgaagatatattgttctcattaactttttttcccccaaaattatttgtaaggataaatcatcaaatcccctacactctcttttctggcaatccaactaatgaagaatcactttgctaaagtgatgaaaattcatagttaaagaatgggagattcataaaaatctgagaatttataaacttttgatattccatttcattcagtttcttcctcaatatggccatttaaaaacctgcagagtctgaacactttatctgtggctgccaacttacttctttgcaaatctagaatattctatataaaaccttctattaatgcctgtgcactgggtactcaaagtagaactggattcaagcagaaaaagccacataaagctgaaattgcttatgaagtattttaaaccctgagaatctcaaactttgtttgaagaaacaggagtagagctcacatcagcattcccaccccacagctgagcacaccctgtgggtccaaggatgtggcacacatgcgaactccacttccaagcaaagcagcctaaagagagaaaacctctaaaagaaaaaaagccaaaagggacctccaaagccagaaaaccattacagtcagcagaagagatttgcttgcaagacacaaccctgtctcaattaggacttttctgttttcatgggtttgggaaatctgaaacccttgagaaaaactattgagtatattcaaagcaagatattcattggtgaattaagttctctgtttagatgtgcaggaaatagcattctttgcgatgcttgaaattgaggacagacagggctgcagaggttgcatgatcaaagcaaagccctatgatgaaaaagtaaattgcctcttatgttctttgatgatgcagactgcacttgagaacaaatttgatgatttttgcaacacatcaggtggagccggagagggactgcagggttgaatatagcacagcttttttttgttcttaaaatccccaaattcttaattttttaaacttcatttttagattttagttttgtatttaattacgacttttttttttttttttttttttttgagatggagtctcactctgaggcccaggctggagtgcagtggcgtgatctctgctcattgcaacctctgcctcccgagttcaagcgattcgcctgcctccgcctcccgagtagctgggactacaggcgtatgccaccaggcccaactaatttttgtaattatagtagagatggggtttcaccatgttggtcaggctggtctcgagctcctgacctcaggtgatccacccgcctcagcctctcaaagtgctgggattacaggcgtgagccactgtgcccagcctacaacttttaatttccaagaataactttgcaaactcttttgtcctaagtatttaacagcattccttctttttcacctcagcataagaaaacatagagaggcaagtgtaacttaagtttataagtcacttgccatagtcctctccagctaaaatagtgacagataacatttactgagtttgcagtgcagattagatacatgtattatctcatttacgcctcacaacaacctgaagaggtggctactatttaatattattcctgttttttagatgagaaagctgggccttaaagaaacaaagtattgctcaagatgacacaatttgcatgaaagagaagtaaggcttgaacccacgcccatgggctaccaagcctgttctttggcaacaatcctatcctgccttgctgacaaagagatgggatcatttagtgtgatataaaaggaattaactggttgaggtaggattagacagaagccaccaggctgtgaataattaatttcagcaaacagaaatacatcttaaccatcaaaattatcctgtatttcaatagctatgggtcaactttatttacctatttttaatttttgaaacagggtcttgctctgttgtccaggctggagtagagtggcatgatcacagctcactggagccttggcctcccaagctcgagtgatccttccacctcagccctctgtgtagctgggactggaagcacatgccaccacacccagctaatttttgaaaaaaaatttttgtagaggtggggtctcactatatttcccaggctcgtctccaatcctggcctcaagcaatcttcccaccttggcctcccagagtgctgagattacaggtgtgagccactgtgcccaaccttgggtcaacttaagatgtctgctgaggtggttgtgaagcagtaactgaatttaatcctgattccagccaagaagggttcctgagttaggacagaaaagtaccaacagcacttgctcaacagaagcaggtgttaaaatacgcagacagcacagtgagaaacggctcagggtgaaagctcctcattctaccttcaacagagatgacagcaggcctgactgtgggtcctggcacttttatttgcaagttacatgactaatcactagatttctctggtcctcagttctctatctgtaaactaagtaggttgaactagaagacctctaatttaatctagagattgaaatacatattaaaaaacaaacaatcaggctgggtgcaacggctcactcctgtaatctcagcacttcgggaggctgaggcaggcggatcaattgaagtcaggagttcgagaccagcctggccaacatggtgaaacttcgtctctactaaaaaaaataccaaaaaattagctgagcatggtggtgccacctgtagtccagccacgtgggaggatgaggcaggaggatcgcttgaatctgggaggcagaggttgcagtgagccaagatcgcatcactgcccttcagcctgggtgacacagcaaggctccatctcaagaaaaaaaacaaaaaaaaaacaaaccaaaaaaacccccaaccaatccaatcacctgcatgatgcctgtacttcctctgtcatgtcccttatagctccagctgcactcagataaagctatagccagtctgcctttgccacctctgagcttggttctgtttctccgtagcatcaatctttggctctaatttaaatatgggatgagtatcccttatccgaaatgcttgggaagggaagtgtttcggattttggattttttcagattttggaatattggcattatactttattttttgagatggagtctcgctctgtcgcccaggctggagttcagtggcatgatctcggctcacttgcaacctccacctcctgggctcaaccaattctcctgcctcagcctcctgagtagctggcattacaggctcctgccaccatgcccagctaatttttgtatttttagtagagatggggtttcaccatgttggccagactgacctcaaatgatccagccacctcggtctcccaaagtgctaggataacagccatgagccactgtgcccggcctgcattatactttatagttgagtacccctaatctgaaaagctgaaatccaaaatgctccaaaatttgaaactttttgagcaccaacacgatgctcagaggaaatgctcattggagcatttcaggatttgagatgctcaacctgtacttgtcccttccagacacgacaatatcgaattaagtaaaacctcaaaatcaaatgctattaaatattactatatttatacttttatttataatcaatataataagagttcccatcaaatgaatattctattagttaaatcctacaaatcagtttaaatttttaaataattagaatataatgaaatctataacactacgatgaccttgaacacaagtttaatttttctttcaaggaactcagaatccttttaaacgcttacgcctcagggacatcgttaagatgacaatgatgtctgcaaattactgtagatatggaacgtatcagcgattgggccatggctatgtatctgtaagaggtactgggagagacttttattcctacgtggaggcagacagccaggcagacagaggtcacaacatccaccaaggagattgtgcctggaggtgggaaaacatgctgtactctctttaggtaaactgctgacttcagcttgacctccctagacaagggcctgagacttgtaaacctaaacattttggaaacatcccacaatggtggcactttgagccttcaaccagacaagcatacgaaggaaagaaaggggacaagtctttaaggaggaaaaagtgtccctacccttgctctcctttttatagacaataatccagaccacttgaaaatgagtcatcataacctggatgatctgggccccttggatctgaatgtgacagtcttatgactcgattttccagcccagagttaatccttatccaggactttgcagtaaaggcatgagtcagacacttcacgcagacattaatatctgggcctcatgagaatttcatttgttttctgccttcagcaatctgccccagtgagcctaacccagggactgtcctgaggctactaaatgtctctagttctttcaacatgatgttcttgacgctcagagggctctaccctacagctgaaagcccaggctggactcggtggcttgtgcctgtaatcctagcattttgggagtctgaggtggatcgcttgagcccaggagttcaagaccagcctaggtgacattgtgacaccccaactttacaaaaaagaaaaaaacaacaattaagcagagaccaacaacggcgatacaggaaaggggctaatgggaaagaatgtagtcagagcatacatatacatcttgtgttcagtatgcctcaggcactgcgttacatgcttccaatgaattatgaagctgaatcatcacagtaatctcttaagatagacactaatatcttaagatagactcttaagatagactccattttacagggaagcggtgagggcactgagagcgtaagtaacaccttggcaagcacacagcgaggaaaagccagagctgagattcgaacacaggcgagcaaactcaaagccctgctgtcactcaaccattcctttgattgtaaaactgaggaagtattcagctggtataatttttaaaaaaattattcttaaccagtatgattttaaaaaatagctcagtgagtatttcttagagttacatgattgtgtgtgacacaatgacaaaaactatttttttttttttttggagacagggtctcgttctgtcccccaggctggagcaatcatggctcactgcagctttgacttccttgactaaagcgatcctccttccttagcctcccaagtagctgagagcataagatgtgagccactacacctcatttttatttttagtagagatggggttctcattatatcgcacaggttggtctcgaactcctggggtcaagtaatcctccctcctcggcctccaaaagtgttgggattacaggccagagccactacatctggctgacacagattttttttttttttttttttgagatggagttttactcttgttgccgaggctggagtgcaatcgcgcaatcttggctcactgcaacctctgcctccagggttcaagtgattctcctgcctcagcctcctgagtagctgggattacactcacgtgccaccacgcctggctaattttgtatttttagtagagacagggtttctccatgttggtcaggctggtcttgaactcctgacctcaggtgatccacccgcctcagcctcccaaagtgctgggattacaggcgtgagccaccgcacccagcccacaaactcttaattcagtgtaattaagtgtaaactcttaattcagtgtaatggctcaggtaccacagaaccctgcctacttcctgagaaacactgtaagatttccttcagactttgagacaccatgtggctagatgtgtcttcaattcacagcaaggagaggcctgtaggacccagtgaggagggatgcataaattgcccctaaaagaccaagtagaatttctggcaagtaacgttccataactggcaggtttttgggcctggcctggtaaactgtcaacagtatccaaaacatggctccgaaccatatttctctgacagtttaacataaattcttccaggttctgtttaaagccatttcctcttagaaagtagctgattatcatctgctgactattaagctatgaggtacttaatatccatttaaggtttcggtacagccaagtcaaattcagcttgcatcctggaaccttgtaacaagcagcgatgttacttctgggcatcttctgtaaccacctcctcacgtctcactgacctcatcctggcccaggggtgcagttccttactcctagaaagcgctagcccttataagaatctataaacttcctaaaatagaactaacctttattttgcttccggcagtagttgggcgccctttcttgtcagcctgcagattttccggaaataaagactttatgaaaggcctggaaaaggagaaagagaatgaattaacaatctgtaagtacctctggggctgaaagcctgcctttctagaggatggggtgaagggccgtccccaggcacataaccttggctacagaaaagccatctgactcacagcgcgggccatcaagatgtgacttggggaaatgaacaacggacaaaagtcatgaagggaaagaattctaagatataagcaatttggaatcaaagactgcaaaataaattttaaaacaatgcctttccaacgtccctagtcacaggaattgaggtatatcttgacagaacataacagagggaggtcagtaggggattttaggtttttgttttgtttttgagacagggtctcgctctactgcccaggttggagcgcaggggttcaatcatggctcactgcagcctcgacctcccagactcaagccatcttcccacctccgcctcctgagtagctggcactatatataggcagacgccaccacgtccagctaattcttgtattttctttagagatggggtttcgccatgtttcccaggctggtctcaaacaactggactcaagaggtgctcctgcctcagcctcctgaagtgttgggactacaggcatgaggcactgcgcctggccagcatgtgtttgttaagacaagcaagatagaccagagctcagggaattatatgaaatgtctggattcagtgcagatgctgctttgctctagagcagagtttctgagtctgggcaccattggtatctgcggctgaataattctttgttgggggccgaggagggcgcctcttctacatattgtgggatatttagcagcatccatggtctctgctcaccagatgccagtagcacactgttcccagctctacacagaaaaccctgacaaactgcttttgagtatgagcaattttaagcggagcagtaacaaatcaccaggctctgccggctgaatatactttcttttttttttttttgagatggagtctcgctctgtcaccaggctggagtgcagtggcgcgatcttggctcgctgcaacctctgcctcccaggttcaagtgattctcctgcctcagcctcctgagtagctgggactacaagtgcgtgccaccacagctaatttttgtatcgttagtagagacggggtttcaacatgttggccacagtggtctcgatctcttgacctcgtgatccacccaccttggcctcccaaagtgctgtgattacaggcatgagccactgcacccagcctgaagatactttcattagtggtgctatttgagctgcatgtgtttatacgtctgcctcactagcaacagggcagggacaatgccttactcatcttagtgtccctggtgtctgaagcatagcatggtgcacagttggtccataatatgtatttgctgactgggtgaatgacgggatccatgtaaattagcaatctgacattcaaactcaaactcacttcctcctcaatgactttttgggcatcttgaattttccaggaagtctccccagcagtctacttttaacttgaccagatacaactacagattttgacatcaagtgtgtttacaaaataataggccatgtccgtatgacagcagtttatgtggaagcaataatagctcttaaacttggcaggaattttaataattttttaaaaacaatctctggaagcaagtctgcacctgactgccataaaacccacaagccaggacttgtggcttacctaaacatctcagagaagaacaaattgattatgtatgttttgaataaaaagaaatgcaaaatctcagaaatggtggtgtggctgcaaggaagcgcagggatggagagcagagggtgaggaggggtagggagctacagggagagaagtaaacggagcagaacagctgaccagggcctgaaaaggaaactcttgctttgctttcattgcagtcagccctttaataggaaattatcaggctcgctgctgttgatcagagaagctggccttgctattgtgacagcttaactaatagagagcaaaagggcagctcttacttgaaagaagctctagaaattgtaagatctggcatgcatgggccttgcctcgcaagcatgatggacttgctcatgtaaattacatcttatgtgttatccaggatcttgagaaccttttcagggaaaaggggaggaaggcagaggtggtcttgagagttctagcagcgtgcaagggggataccctccctcttctacccctacagctgaaacagggtcttgggagttaaaatggatctcttagtcactccttctttagttgtccctcccagagttctcaagccatttcttcagtacttcagggactctggttaatgtgggtcttgctaagccattaaccatctttaaaaattcaacgaccatgaagaagagctcaggggcaaagtatcatagaaccagactgttccactcttaaatagtcagaaatggccatcccaatccaaagccagtgggcttatttctccctgataatagtattgaaaggtagaaagcctgaggccctgaaggacctgtagatggcacttggaatttgggggcatgaagtgttagggacataaaagggagagactgatatagagaaaagaaagctattttgagaaaccaaatagattaaatgataatccagacccaatagcatgaaggaacaaaatgctaaccactaaacatcacaggtgttttgttttgtttttgtttttttctttattagagacacagtgttcctatgttgcctggctggagggcagtggctattgacaggagtgatcacagctcagtgcagcctcaaactcctaggatcaagtgatcctcctgccttagcctcctgagtagctgggactataggaacacaccaccacacccagctcataagtttgttttcatattgaaaatttcatcaaacctatatcccctgtcagctatggcaaaacatacttacagctcgctgctctgcataagctcgatgagatccataaaaagcacatcccggttcctttcacaaaagccatccatgtcataggatacctggccaagaatggaaagaaatcgaatttcattgaacaaaatgtaattaattgaacaaaatcatttattgaacaaaaaatctaatttcaccaaacaaaaaaccaaagctgtcatggctaccctcaccacaacatgtggatttccagatgttgcatttgggatttcattgtgcactgtcacaggaaggctgtgcacgtcttacttgttagctgacttagtggggaaggcctgcagatgctgatgagtatctggctgcctggatggcccagctgatccgtaatcagaactccagctctcaagtccccataccccttcttcagtggatccataggggtgtctaagtgacatactcaatacttttcctaaattttagctaagccagagcaaaagtgaagcccctcatgctcagtaattcactgcaatgagccatgtcatctgaggctttgcagtttctcccagaagtggtatcaaagttgcaccaatctggccagaaactcatgctcagatactctgtttaacaagagatcagctgggatgatggatgagaccaggggatttccatagcactaggaagtccccaagaccacgacctcaacttaacttttttatcatcagcagccccacacagcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagccgactgtcccagggtgggtcctggccaggactggcaccaaggcagtggaatcctttcaaaataggcctccagcgccatagaccagaaagcaggcgcccaattctgggacactgggagatggtgcaggcagccaccagtacgcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaagcatgtcaactattgataatactcttagcaaaactaactccagaaatcacttgctagagaagcagcccttcactgccttagtctgagcacccacggaaagcacgtgtcggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaatgcagtagtatatacaatcttttgttttgcttcctttgatagttaataaattccgtttgttgaatcaataaaatacggcgagccatatgatttgcttcatgagaaaccagatcacaaacccaaaggcttaaaacagatagacattaaaatggatattggccataccttcccagcataatgatgaatgatgaagccttggttccaactgttgaagtgctcatgactcccaatctgcatctgaagtttctggagcagcgtctgatctgccccctcacccaccgcatgcatcgtggcgcacacgtcatccaggatgctcatgatgccaggagggttctgatgggagcaagaaggcaaggccctagtcactgacctctccaaaacagacaatgcttatcaggtcctttcttaggcaaggaaacagctccccagacttaagataccatcttgaaagtcagtattccccttcaggcaagaatgcaattaatagtcccaaatagggagtcaccacttagatctaaagagggaggaaactccactttccaaaaagctgtttaactccctgaagttttatccaagagtcatgcacagatcattatctgctcactcatagtcatgccaaattgacttgcttaagaatccaaaagtaaaaacattttcctttgacctaatctatttcttaatgttctctttcagcgtgttacccatataggcatcatttcggtagttatttagtgtacacattctataatgcatttcctttttcacatagcactattttataagcattcctcatgttttacacattcttcacacttactattttaatggctatacttctctgttctgatatgctatagtttgtttaataactaagttgtctggccgggcatggtggctcatgcctgtaatcccagcaatttaggaggccgaggggggtggatcacgaggtcaggagttcaagaccagcctggccaacatggtgaaaccccctctctactaaaaatacaaaaattagccaggtgtggtggtgggcgcctgtaatcccagctactcaggaggctgagacaggagaatcgcttgaacccgggaggtggaggttacagtgagccaagatggcgccactgcactctagcctgggcaaccgagcgagacgtctctcaaaataaataaataaacatgtaaataaataaataaataagttgtctacggatgtttttactgtttccagtttttggcttttatatatataaaaaaatcctatagagatatttgttctgtatcacttttattttgaatcaccttttttttttttttttttttttttttttttttgagacatggtcttgccttgctctgtcacccaggctagagtgcagtggcacaatctcagctcaccacatcctcaacctcccaggctcaagcgatcctcccacctcagcctccagagtagctgggactacaggtgcgtgccaccatgcctggctaatttttgtatttagctaatacaatttttgtattagctaaattttgtgtttagaaatagggtttcaccatgttgctggggctggtcttgaacccctgtgctcaagcgatccacctgcctcagcctcccaaagtactgggattacaggcacgagccaccatgaccagcctgaatcagtcattaaggctaaagtcctagaagttggactagaacacagggccaattttatggctctttccatgctaagtcatcatgtgatcctgtcttctcttagaattcaataacaacttccatttgtacattgacattttactcatatccacatgttcatatttactgccagaataaagccgtactgttctcttttcacacatacagaaaactagtacaattgctcaaattctctgcaaatcagagttgtcactttgcctgttctaaaacaatgacacagagaataaaaactcacttaatgtaaacctgtgagcagtgaaaagacatactaaatgaacacttaccactttgttctctatgaggtcacatacgattttattattaaagtactcaatgggtgtccatcttattccctcttgaacatattcttcctgtaacacagagacaaggaactcacattatttcccagatagcaagagctctgcacggacagaccctgaatggacaaaaattcccataaaagagaaaaacctgaatgtcctgcaacaaagaccagggactttaatttttattttctaagaggtaacaggaaaggaacattttatgacttggtgatttttatgtttagtttgaaccctatgaaattattgccacacaactgtttctggccaaagaaaactacaatttagtagcaccgaactgataaatccagttacaaaaaaatcacaaaactcttaaaatttaacataggactgggcgcggtggctcacatctgtaatcccagcactttgggaggccgaggtgggcggatcacaaggtcaggagttcgagaccatcgtgaccaacatggtgaaaccctgtctctactaaaaatacaaaaagaagctgagtgtggtggggcgcgcctgtaatcccggctacttgggaggctgaggcaggagaattgcttgaacccagaaggtggaggttgaagtgagctgagattgtgccactgcacttcagcctggatgacagagcgaaactccaactcaaaaaaaaaaaaaaaaattgaatataggacaggagtacagattagcatccaggtacttaatgggaaggttcttcagtctatgagttgctcatttaacttgaacaccacaacaccatcctggttttttcctctttcctcactggtttcactttgtcagcttcctttgccaggtctttcttatttccagacctttatatgtggtagagtctcagggctcaatctttcagctttctcattttctcagccctccttctctaggtgatttcaatcaatcccatggctttaaataccacctacaggctaatgacccctgaatttatttctctagtctatacctcgccacggggttccagactcaaatccattctacagattggaatcttcacttggatgtatgataggcctctcccacttaacctgtttagaggaactctgattccatatttcccgtgacctccaaacaacccctcttctaatcttaccctccagtaaacagtgtcaccatcggccctgttatccagggtataaagctaagaatcacccgtgattgctctttctttcttggctattgctaattattttgagcaagtcccattctctcactctccagatactccccctccccacctacactgctaccatggccgtctaagtctctaccatgtctagcgcagtctcctgcagtatccccctcactggtttttaaacttccattctagtttgctttcccctgactcatcccactctataagtctatagagccagagtgaccctttcaaaaacacaacaaatcacatcatgtcactcctccctcaaaattcttcagtgggtcctcattccacttactgtaacacccaaagtctcagccatgccctgcaagttcccatacaatctagcccctgcctcccctctcccatctcactggctattgcactcttacttggttgttttgctctggctactctaagggttggggaaggctagaggttcacaggaaacccatatggaaactaccaaaccagttaggagactactgcaggagactgggctagacgtggtagggacttagatggcaatgggagcaatgggtttcatgtgaacctctagcctaccccaccccttagagtagctacagcaaaacaaccaagggcaggttccagggcagaaggtcacgtgaaaccccctggtatggtgtttcctaagcagaggcataaacacttccataactaaatgaccccaaacagcctttgatgtgtgtaatggcttgaatagtatccccccaaatttcacatccacctggaacctctcagaatgtgaggtttggaaataaggtctttgtaaatgtaattcactaaggatctcacaataagtcatcctgggtttagagtgaacttgaaatccaaaacaatggtgtctttcttttctttttctttttttttacagttcactctccatagagactgtcaaaaattgtcaatgctgactgtatttccagtcatcatggcagggtattgtgaaaagttttcaattagcaataatcatgcctcagatgaacagccctggctaaaatattgccattgcgcaaagctaaaatggtgtcttcatgaaagagacggagatttggatatagacacagagggacattgaaaaaggctacgtgaagacacaggcagagactggagtcaaactgccataagccaagaaatgccaggagccaccagaaactagaagaggaaggattctcccctctatcctgaggaggaggaggagtgtggccctgaggacttcttgacttcagactctgggctccacaactgggagggaagaaactgctactgttttaagtcactcagtttgtggtgctttgttatggtggccccaggaatcctaaacaatatgctatcaggaaacaatggaaactgcactgaactatttatttattattattattattattattattattattattattattattattattttgagacgaagtctcgctctgtcgccaaggctggagtgcagtggcacgatctcagctcactgcaacctctgcctcctgggttcaagcgattctcctgcctcagccccctgagtagctgggtctacaggcacacaccatcacgcccagctaatttttgtatttttagtagagacggggtttcatcatgttggccaggctggtctcgaattcctgacctcaagtgatctgcccgtctcggcctcccaaagtgcagggattacaggcatgagccactgcgcctggctattatttatttttgagatagagtcttgctctgttgcctaggatggagtgcagtggtgtgatgatataagcctcgacctcctgggctcaagcaatcctttcacctcagcctccagagtagctgggactataggcttatgccaccacgtccagctaattattttattttttttgtatggatggggtctcattttgtcccgcaggctggtcttgaactcccgggctcaagcaattctcccgactcggcctcccaaagtgctaggattacaggcacgagccacagcacccagcctgcagtgaactttagaagaaactataccaaggcatgttacctcaggtaagtattcaaataccagctttgttaaaaatgcacgtattgttagggaagattgaaaatggcgtagatctgaggaaaccaagtcttttatttggaacacaatatttgccacagacagtcggggctggaactaggctcccatttcccacgtgctcaatgagtcagtagagtaaaagcagccagtcttacctccaacatcacagcatcatttgcttaaagaagaaggcaaatgctgcagacggtatttatatttcatagattaaaatgccacaatggcatatggtttttctgcctgactttattagatgcatttcctaatataagactggaaccgaaatctattaacaaaagacagaaatctataccctcttaaacaaaataaattataaatagaataggatgaaggaagagggactgcttacctgttctgcctttaatgtcagttcaataaaaatctgctgcagtttttcattaacaaaattgatacaaaactgttcaaagccatttttctggaaaaaaaaagttattcacatgtaattctttcacaaaatcatttaaaagtcatttctggagtgatttattgaaatgtcttcatgtgaaaagctttaatagaaatgttggatgcatcaaaagaaataagtttatatttaggagaaactaatttggtaaaggcacatgaagaactcacaaaggcaaaaatgagcctgagttgttttttttgttgttgtggtttgttttctgtttttttgtttttgcattgcctagaattatttcttgcaggccagatgaaatacgtcaccctcctcaacccctagttattaaaactggccttacctggaatatttcaaagccatagatgtctaggacgccaatgttgtattcttcatggtctttctccatggctttattgatggactagagaaagtaaacagcatggcagtgaactcctttccattcatactaaaaacgggcatgcactggggaaagggaagctggattctacacggcaaacactactgcttgcaggaaacagaggacaagtgaaggcaggagacttgctgctttaacaatctctcagtccaaagtcaagtactttggaaaaccaccaggattcagaaaagcgagtacagtagaaacaaaaaatgtttgtttaatgatgataaccattaatttctgtccaagtaagctttttcaggaagtcttaacaattagaaaaaaatgtcatcttggatgatcgaagtaaaacctatttcacacaaagaacccacactaaaggatctgtaattgtcatttccagtgtcttccattcaccagtcatttaatgatgacccaacacaatatgccagggatgctaaggacaagacaacccttgttcctaggcgcttatagagagggtgagctatctgcagatagtaacaatagtcattatttttgaattgataatagaagcagcttacgtctattaaacattcacctttgccagggtttgctaagtgctctcaatgtgttgtttcacttaattcccatttcagttctcaaaatggcagtgataccattattttcccaattttccacatggatacaccaaggcttgcttaaggttgttctatgtaagaagcagggtctgggactaaatttaagcagtatgatgcctaaatctgtgttcttaatcaccgtgagaagaggccaagcaattcatgggaacagatgtaatgacagcaagggaggtttggatagagcggttggtgggggatgcagtgggggaggaatgtaagcgaacaattctttgaggtgatgaatacctggacgaattctgaagtaccagaggtgttttccaggcaaacaaaatgaaatatcatcttttgtgagcgaatgagtaatcatacacaacacacagtcagtgcccagtaaatcccacctcaaattaggatcacttatatgagtattcatgtactggtactattcacaaaaaaaactgacaggtgacaggtagaaaggtaggtaggaagcccagcgctggaaggtgctctgaacaaagagaaaagagatatggattctagtcccaggctgcaccacccccttgctgaccagccttgggcaaaaccaccattgctcaggcctgaagttcccttctcagtaaaatgaggggtctggacaacctaactgcatgacttctgtttagtatgaccctgaccttcccaagcaatgttatcctttaaatagccactaaagtacctagaatagttctcctaccctgtcctgcctgaccctactctaaccacactaaccataccttaagccgtataaatgttagtgcctggaatcaaatacagatcttttggattgaatggcccccactgttgtcccttgactagggtccttctagcttgaatatataaacgtcaaagaaacaaactagctaggaatctagggcctcctagatcactcacataataacagagtgaccttgggcaaattccttaatcgatctatgcctcccttagtttatctgtaaagcagagataataatacctaagtcacagggttgttgtaagaattaagtgagggttttttctctttaaaatactcagaacagtatctgggcactaacatagttagttctatataagtgcctgctattattattttaccatttagaggctacagtgattaacagagattgttactggcagctctacactgctgaaagactaattgtcagaatatatatgtgatatacatatataaatatatattcatatataagagtttatgtgtgtgtgtgtgtgtatctatctatctatctatctatctatcttttggatcgaagggcccccagtgtgtgtgtgtgtgtgtatgtgtatatatatatatatatatacacatacacacacacacacacacacacacacacacacataattatgccataaccaaaaatatctaatagtttcaaaatacatgcaaaaagtttttgatattccttcctctaaaaggtggagcctcattcccctccccttaagtgtgatctttgcttagtgacttgcttctaataaacagaatgtggcaaagtgacaatacctgagtccaagattaggacataaaaaactggcttcttgctcattctctctttcagatcactcgctctggggaaaaccaaccattatgttatgaggatattcaaggagaggtccatgcagcaaggggctgagacctcctgccaacagccacatgggcaatccatctttcagccagatcctccaaccctaggcaagccttcagacaaccacagttccaatcagcttcctgactgcaacctcgtctttgagtcagaaccaccaagctcagccgatcccaaatatctcaccctcagaaactgagaaaataagtgcttatggtttcaagccgctaggttttgggttaatttgtaacatagaaatatgtgaaaaacatattcctaaatctttaggtccaaaagtcaagaaaggcccatgaacgtggctctcctctttttctggtctctagtcctagctttactaaatattttgtccagaagaaacttgttaccacattagatttagctaaggtatcttggtgggcagttctagaaggaaaagcaggattcagtaatcacagagtgagagaaagtgaagtaaggtaatgggtgaaaggaaggagccagaacaggaacacaaaaccctcagtcgttttaccttttttttttttttttttttttgggagataggatctcactctaacccccaggctggagtgcagtggcgtaatctcggctcactgcagccttgacctcccaggctcaagtgatcttaaccacctcagcctcctgagtagctgggaccacaggcacatgccaccacacctggctaatttttgtgtttttttgtagagacagggtctcaccatgttgcagaggctggtctcaaactcctgggctgcagtgatcctcccaccttggcctctcaaagtactgggattacaggtgtgagccaccgcacccagcctactagttttactctttatagctaagatatgaagcatcaccagcatcaacttctgttacttacatctaccaagaaatcaaagacccgggcgtgcagggccttggcgagcgcatcccgggtgtaacaggcctgctctacgttgagggtcacgtggatggattcggatttgcctccccacttgctatccatctgccggcttgttagcttttctttcaaccggtcctggtttatccctagcagatatgcaggaaaagctaaaactgtagaacataaaacaaaacatgacaatctttcagaattgtgacacttccaagtcatctcacaaacatatggaggcacttatgtgcacatgcacgtgtgtgtgcatagaaggcacaatcacgggccccaagagcttacgttctagtgaaggctgcttatcagtaatcccatacacatccatctcctttgtttttcccaattgttttatgacatgagtcaattcctatgatgactgagacttccaataatacaaatcagggattcaagaaggatggcaaacctatccctcctactgagatcacagtcaaatgcctaaaatggacatctctccaagcttccagcacgacagccaggaaggaactcaatcaagaaacatttctttggctccaaatattgttttcttcctttttagtacaatgttttcatagcatcatttttgaagcacctgatattactgaactaataattacaaccaatcccatgtttattgagtatttagcatgtgtagggttactaaagagagaggaaaagatagaaaatatgtaagaaatcttgaatgcaatctagatgaggcaaaaatagtttgccaaataaagaacccttggaaaagctgaatatgtaacacagacagacaagatctggagaaattagaacaggaagatattactacttgctggggtagtcaagagatttgagctgggtgtaaaggatgaatacgatttgtgcagatgcagagaggagaagggagtgtaccaaggggaggaagcagaagtgtgggagacatgatcaagacgagacggtctacagtgtgtggactagcactggctacaggtgaaagttcaggtcagatttaaaaggttaggacagattccaatgctgggggtccttgaatggtatgatatatttgggctggaggcaaaagggggcctgatggctaataaagaggggcattataagaagattcctctgagggtagcatatggagtgaaatgaaggggatggtattgttcatatcctgccctaatgtcacatggtatggcagtctgtggtctttggatagaaaaacggagacttccatagctcaacatcttgtttcagaccatgaaacttaccaaggagggctagtgatataaatggggttttcttgatttctgggcagaacgttctcatataaataaatgacaccattctttgacatgaaagaatgctcagatttttccaatatgaatgaaagatttttatagatgcaatgcaaattttgaacttggctgagttttctttttctgcataatgctttaccaaaattatctgataaaagaattttgttaaaggccttatgataatgctaaaaaatcacaagcctcccaataaaggataatctgtttgaatttcacagatggtgttagaatataacgggctgacatttctcagtatacaccttccaatgagattaagtcagtgaatacattttgaaaaagtataatgccagaacaagacatttatcctctatatgagtgtttcacaaaaatgctttgagcaatagaagggcttccttttagaaaggacatgtaaacaaaatcaaatgcactgatctgaaaatggccattatccttagtttagttttactgttaacacatgtctaggaatctggatatgtcttccagtgaactaaacgtgcattcatctcacagagttgaacatttcttttgattgagcagttctgaaacactctttttgtagaatctgcaagtggatatttggagcactttgaggcctgttgtggaaaaggaaatatcttcacagaagaactaaacagaagcattctgagaaacttctttgcgatgtgtgcattcatctcacagagttgcactcctgtgcacagagtaaggacagatgacattcataaatcagactggacccatgtcgggttgttgtgagaatcaagagacattcaccaacatatccaactaagaagggatttcttagtttgtttagcttcacagcaacgtaaaggtttgaccagggaaatgctacatttccattagtctaaggtcaggtaaaaaaaacaaagcttgtttggccaggtgtggtggctcacgcctctaattactgcactttgggaggcccaggcaggcatatcatctgaggtcaggagtttgagactagcctggtcaacgtggcaaaaccccatctctactaaaaatacaaaagttagccaggcgtggtggtgcgcacctgtaatcccagctacttgggaggctgagacaggagaactgcttgaacccaggaggtggaggttgcagtgagccgagatagcgccactgcgctccagcctgggtgacacagaaagactctgtctcaaaacaaaaacaaaaaacaaaataaaacaaaaaagcttgctgttattaatggctattttgctttagtaggccagttctgatgaaaatcttaccatttttttccattttttttctgcactgcaagagcaagagaaagtctgcttttttccattataaaggcatggactaccacttccctctacaaatttattccatagatatactaaaatatgagaaagatgatagaaaccaaggctattcctttcagtagtgttcattcagtcttgtaacagcagaagatcagaaaccatattaatgtccaacaacagataaataaagtgtagccaatgaatggaatgctatgcagctacaaaaaggacagccaggtgcagtggctcaatcctcgattcccagcacttccggaggccaaggcgggaggatgacttaaggccagaaattcgagaccagccctggcaactaagcaagaccccatctcttaaaaaaaaaaaaaaaaaaaaaagataaagctccttaggaattgatatagcatcatctcacattatatatataattatatatataatatatatataaaatttatatatatattatatatatatacacacacataattttttttccctttttgagatggagactcgctcgttgcccagggttcaaacgattctcctgcctcagcctccagagtagctggaattacaggtgcgcaccaccaccaaacctggctaatgtttgtatttttagtagagacaggatttcaccatgttggccaggctggtttcaaactcctgacctcaggtgatcacctgcctcagcctcctgaagtgctgggattacaggcatgagccaccatgcctggcctaagacacatgttaagtgaaaaagcaactgtagaacattgcagtataagcccccaatattgcacaaaagtgagaaaaaggagtggttgtgtgtagttgttttggaacacacatcctttaaagggaacacaagagactgagaatcttggttacctctgacgaggggaacaagtggactagaaaaggtatagaagggagaactttcactgcataccccctcaagccacgttaatgtattaccaaatgaacaaaaccccaaatcaaaggaaattattggtagggggaggcccatttcctggacctctctggcttccatctcagccttttccaatctccatgcctccatcgcctctagtcagggaatttcatgggcagttgccagtgctcggccttacccatctggctgagaagactactaactctggacatcaatgtgcaataaaacacttcttgtttcaaacatctagggaagtgtttgctgtttcagtgtcatgattttgttttcaagcataaagaggcagtaaattattttactatccaagaaggcaaaaaaaatccagtctacttcaacagaaactaccaccaaaccaacactgttacaattaaaaggccaagtgttaatgatcctactggaaatatatgtgcatttgttaaatgtcaaggataatgtacacaaagtttagaaacatagttatccttattatgattattaggtcatgtttttagactttatggacaccctgtatatttattgttttctactcccttccctggtaaacataattcatctttttctttatcagatagacatcagaagttagcagaacttccctcttttatcagaaaagaaaacaaaaacataaaaaaagaaccttatttggaatggaaatatccccactgcattgtcagcaatgagtgggatgctatttattactaagcatctaaatttatcatccttaaagaatgctgagaaaggaagaatgtcttcctgggtggttaaaggatgtgtgggttctgagagcagcctgcaagctgttgatgcctaagaggctaaagtcatgtgccgctgtatttatggtagattttgggcacatgtaaccagcagcacctctctgtaggaagaaccctgattttttttctcaaagagtaaaaacgaccatttaggtgttgaggctccaggtatacagatgtgatcattaaaagtgatcatcagaaatgtcaacacaacagtcaatgtccatctttttctgtgttcagaaatccaatgtaatccaatccatggaacaaactgtgaagctgtgagcttcccatatttacatatattatattgcttgctctttaaaacctgtaagtgaatttagatcctaaagaccagttactgaaaaggttttgataaagacaataaatcttttgcattaagccattactctaatccccattaaagagatcactttatctttaaaccaaggtgtgaaatcctcccagctttccccaggttaatgataaattgaaacgattccattaataatcgatggtgtgggacttggaaaggctgggggtaaggacagggacaggtgcatagaagaggtctggtctctcgtgaagccattctgtttgccacagaggacatgtagatttatcacttcttcccaatattcccatttgagatctaagcaaaggaaagtgctaggttacttctaatcagagctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaagagaaactatccagagaagctggtcaccagctttaaaagcaccttaggaagaagccaaggcacagcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaagagtggtagttgtacacaaagtctccaagtcctgtcttcatcctttgatgtgttcttgttgccagcttcccctcgaaggtcgctgctgacctttccacctactcaaagtggactcgagatctttcccttcatcaggagggataagaatatattgtacttgcaaaaggatcttaatgaaaaatctccaggaaatccaataaaagcatcatttaaaagtccagtttctgaggtcccttaaatgcaataaataccgctaaaatgtctaaatcttaagagaaacatctcctaagaaaactacactctaggaccagtgtgcagactccttattggcacttttccccgcagctgctttgaggccatgtgacctgttgataccattttgtttcctggcacccaggacacagtctgtttgaactttctgtccctttcaaccacaaatgtactgaacccacgctgctcattcagagtctactgctcagttctggatctgggttgaggaatagtccccagcttgaaacagactcaaagggcagtgggtggcaatgaaggcctttgaggccaagtgggtgttcagcctacctccagaaagttctacattattgcccccaggatggaacccctccataatctacctagtttcacagcttggaccataacatacatgcaatgtgaagggcatggcacagaaaaagggtcctctgccctaaacaatacagaggggaagagagtcttcaaaaccagaaaagaaataagagaaaagactaaagacgttccaaaatgtctaaacctattcagtccatagacgtgcggtttgcttagcttttctaaggaaatagctcacgaatagagtaggccatcagcaaacaggtatgctcaacgtatgaatcatttttgcctatttatcagagctcctgcagggtgataatgatgaattcatttctttttacccatctcaaatcattaagtggtcctcaggcaactggcacatggctgtttaaggatactgaaacatgtatgagcatacagagtgctcacagagaaagaggcggacatttcatgcagctctttgctttattaaccttcactgcccttttggccacaggaaatggccagttgggagagcagatcctgcctggccctgcgccagcacttaccagagtttcctgaaactcccgcctgtcgtcaatgtcatcaaccttgtatgagcccgagaggctcaggtagtaataatagtccatgctggtgatgccaaggctgtgtttctgctctgcagaggcgccctcgatgagctggagcaagagaacacaggttgagccatgatgtggaccacaaggcacccgaagtcactcctgcatcctgcagccaccatccctaaggactttctatctctgctttctaaaattacaggcagtcctggcccccaaatatgtacttgtagtagccccaggtcatctctgcaaattttgattcctaactctggaaagacctgcaagagctgaggattttccattgtccactgaaaggaactggactgccaccctcggaagagtggaaagcaaaacagattttaattacttagttcctgcccaacttgctatggctttttaagctggcttttccatgtttctcactgcagggtgcatgttaaaaaactgccatgcagcttcctgctctctggtactctttgccttctttagaagcttttccttgactgtgaacttctccaagctgcaggatctacttccttgccatgacataaccacttgcattctagcttctcccctcaccactctggcggaacccttgcatggctatttttcagtgcctaaatccaacagccttttttttggcccccacaccccagctcgtcccttttgcccaagagctctgaccatttgatcctgtcgatgtcgccctgaggcttccctggcttggtgacactgcaggatcctggctttcctccttatccttcaactacttccctgctggctcttcaatgcctcccgatcctacatatctagaaagtcccctggtcctgtgtggcaggattttctccccacatccactcccaagtatttcgtagcttcaagaatttctttttctttcttttcttttcttttttttttttttgagacggagtctcactctgtcgcccaggctggagtgcactggtgcgatctccgctccctgcaagctccgcctcccaggttcacgccattctcctgcctcagcctcctgagtagctgggactacaggcgcccaccaccacggccagctaattttttgtatttttagtagagacagggtttcactgtgttagccaggatggtctcgatctcctgacctcgtgattcacccaccttggcatcccaaagtgctgggattacaggcgtgagccaccgcacccagccaagaattactttcatgtcagaatcttgaacccctgcgcccatcagttcccagcctctattctggtggtttctgacttaagggcagagaactcctgggggagggttggggcttgcatttatttaaagaagtcctgacatccattatacacttccatctagcactgggtattatttatgtgaaatatataattatttttcacttatctatatatgttgctttaatacaattttaaaaatgactgaattcacagaagttttaatcatttatatactttttcaaccaacaggtacaaactaaaagaattatttggcattgcctaagatgtgtgtgtaattgaaaagattgaatgtgagctacttccacagtttaatgtccttctaatccagtgatccacaaactaaacacgaaatgaaacaaaacaaaacaaaaaacagtgaccaggtctttcttcgaagaaagtctaatgtggatcttcaatataaaatactaataagtaaatagaacataaaaaatttggttattaacatcattatattttttaagtacttaaaaaccttttacaaaagtacctgaatcagggccaggtgcaatggctcacgcctgtaatcctagcactttgggaggctgaggtgggtgggtcacttgagtccgagagttagagaccaacctgggtaacatggtgaaaccccacctctacgaaaaatacaaaaattagccaggtgtggtggcatgtgcctatagtcccagctacttgggagggtgaggcagggggatcatttgagcccaggatgcagaggttgcagtgagccaagattgtgccactgcactccagcctgggcaagagagcaagacactgtctcaaataaaaaaataaataaaataaaagtagctgactcagatgactgctgaagcctgtaacataatcaaaaagcaccctgcaagctgctctggccccaaactctccatgacttctgagggtctaggtggcaacttttcaatttggcattaaagatcccaaacctatctcaaatctttcctccggtagctcacgttctggagacgcctgccctgcaggcaggctgaggccgggctccctgactggctttccctctcccacctccactgctttggtgcaggtcacctgtcttccctcatcaatcccctccactttccatccgggctctacctccttcacacctctcctactatccggccaaacctgcccacctgaattcctttggcaaagactccaacactcctcgttttgttttgaagttacatcaatactttcttgatgatttagctttggaggaatttctgtcttatcactccaattagaactcactctccttgagggcaggacattctcacaattctgcacattgacttgtacatggtatcatcatcagtcctccctggcttcctagactatagtctatgcctgaagtctgagaaatattttaatgtagagaagggacaggaagtgggtaggaaaaaagtaaacaggaaaacctggtaaaatatgtgaaaactccgctctcctgggttcctcatcaccaccctagatttttccagaaggaagttggagatctttccaccatctggttccccacctggactgaactggatttcaaagtattttccctgcaagaaagttagggatttccttcaatggttggtgaacaaaacatgatgtcccaaacaggctttgaatacagtatataattcaaggaaattcattaataaaatacacattctgaattactcctaatttgagtctagacttccttagttttcaatcagacaataacccgtgcttttgtccagccacacgattctgttagagagagcacctatcattccagcatgactaaataaggatatgctctattccttgctcattttcccccagtaggtgcctgtctgctcaaccagaaggtgtaaatcatgaggcagaaaaatggcatggcaccctttcagaggaagagcactcttgctctgtcaggcttcatctcatggctttgagcaaaaacactcaatctctcttacctacggagcatctaaaatgtttatctagaacggaaacactttattaaaagtaaagttctttctagctactgacgggcctagggatttttgtcactgtcattgttatgaaaattcctctttaaatgactgctaatagggaacaaaggagaataaaaacctagactgtagttgaaaaggtatctaggttgttatattaattatatatagccaggcgcggtggctcacgcctgtaatcccagcactttgaaggctgaggcaggtggatcactggaggtcaggagttcgcaaccagcctggtcaacatggtgaaaccccatctctgctaaaaatacaaaaaattagctgggcatggtggcgggtgcctgcagtcccagcgaggcaggagaatcgcttgaacctgggaggtggaggatgcagtgagccgagatcatgccactgaactccagcctgggccagagagcgagactctgtccaaaaaccaaaataaaatgaatcaaaattatatatataattattataacaattattatatatatttcatatgtatatttaaattggtttttttttctcactagaacttaatttgtctcctgtgcttagaaacttaagcaccctcagaggccagaagggtaaatacggataaaggaaaagagggagtggtgtggtctatggtcaaactggagaagatgcccagcctcatcgcattcacatttaataacataaaaatgtgtatgctgactaaatccacccatctcagggatgaattcagctgggttttatgtctgtgactggagctgtaaactcattaagggcaagaaaagtactgtgcacactgcaaatgtgtgagtacatgccgtgttcctgttcgtaattattctaggtgtcaagaaagaccaccgaaggcggccagcctctaactgtctatgtgtcttaatctgatgattcttttcctccaggcaaaaaacaaaaacacccagcagcaccaggcacagagaaccaccagccatcgctctgcggaatgtcagtggcacctgagaaaagctcactgaaagagagctcccgtgcttcctttggcggccaccttcaccaccctttccttttggcatgtgatagagggaatacttcagtgcctgtcccccattcctcaacagttgagggaaaatgaaaccaaacagaacatctgacccaggaagggcaggtgttggacaggcaagctcccaagtcctcctagcagcagtgctcaaccttggatgccccttagaaacacctggggagcctttccaacatgctgtcagcccaggccacgcacatcagactctaggaccagggcccggagctgtgtggttttcaaaaagcacccagctgatttttatgtgtggtcaaggttgagaaccactgctctaacataataaaatgcatatgcatggctcataattgtcatataaaagttaaaatttctaacaaaaggttaacatatttaggactgctgtatagcagcctgggggggatgacaggaaattttataaagggaataaaaggttgcatttgcattttgataatgaaatgaaaagaagtttcacctcgactcttggtaatgatttatttcctaagctgggtgccagatacatagatgttcattgcattgtttttaaatcgtgtttgaagtatttcgtaatacattctttaacttgaaaagatttgtaagtgttaaatatatacattcttatgcttcataatacctgtgcattttttaaagtgaaattactcataattctaccctgatgccacttcttcattctcttgctaaataattactgtcatagatgtcaaactttgatttacatacctcttagttacctttcatataatgtgcacattaaaaaaaaacaagaacatattgtaaatattgttctgtaatctgtttttttaatttaacaatatattatgaatatcttttaaaataagtagttatttaagcaggaagcttatgtaatttattctaaaagtattgttgggcaaagataatgaacgattaaaattttaataacaattgcccaatcactttcctggaagaatgtgtcagttctcaaccaatagcgtgttttctcgattattatcaatcaacttaatgtttgcccatttgagagacagaaaattatatgtggttttcatttacatttctctcatccatgatggtgaatagtgagagagagagagacagtgtgtgtttgtgtgtgtgtgtgtgtgtgtgtgtgtgtgcaggtgaatgtgtgtctgaattgtctcttccaatctttctatcagggttgtataaaattttgcaattagaaaaataataaatgttgagtgtttttgttatttacagaaactgatatatcctccaaatataatgaataatttatattgcaaaaatcaatgaaaatatcaatttaattgttttttttttctggtctccaaggaatccaagacaggggaaaaggtaaataaagagttaaatttggtcaagtccatttttataagatttagattgaaaattaattcaagtggaaaatttgtttaattcttctttcctattttattatctggaaaacttcttcaggataacacaactcaggcattgggcccaaatatgagagacaaacaaatgagtagtttgaataatattggaaagcaaagaaagtaagggcaagtctaacagatagaacccaccagggaacttgacagttattatatgagcacatagtaaaaattctcttggaaatagaagcttctttccaaaatagacagtggaaaagaaaattgtttttctccaaaattcccacttatttattttaaaacgttccagaatcagcctcacagatggctccgtgaatgctttagtgccagacatgatctatggttgaaataagatgcaaaatctatataaatcaaggttactggataaacatttgtttctttgtaaatgtggcttttgtcaaggggaacatattcatattcagccttgccagctttcctatttaccccctctggagacacccagacagaaacatgactaaatgagcattcataacaatgcacttggttgacattttcattaccagttaggtaagccagttaagaggcaacctgtgaggccaggtccagtcactttgggatgtcgttaggttacatgagtagggcataagacagatgcacaaagccagagggctgcggtgggcaggcagctcgctctgagggatggagaggaggaagtttctctccaaggtgccagatcagtctaactctgtgcacccttcagagtctatggaccaagttctaagaagcaaaaccactgccagtgggaaatgatacctgggatacccctctactctagttatttcttggtctgggaaagaaggtcttttctctagggcataaagacaactcctccaaggccaaagctgccactttcatcatttattttccttagtaaggcaactgatgtggaaaatgattttcaaaattatcttgtttgtatccccggggcgcaaaaaaaggcaaactgcagcttggcggcatgctgctatagaaaatgaaggaaagatcgaagaggtggcctcctgatgatatgtgaaaggctcccatttcctgtgggatactagacttcagtcagaagcatcaacatcatcaatcaagcgacactctctgaaacagggaagggacttacaaatcggctggagttgttgttccggacggtcttggcgttcccgaaggcctccagcagcgggttggactgcaggataatgtccttcacgtgctgtcccagcaaatagaccggaggttaggaaggtgtgaacacctaccacacagtgtacgccaaactttctctaaggacctggtttctgaatgcattaaggtgaggggccccacacccgtgtgtcactggtggggtttctggaggatttattctttcaccatgacagacctcaacctgtttgtgtatttgggtcttccaattcccatggcttgatgcagagtccccaggagccagggccccactgtcaatcaggaactattcatacaaacgttctcagtgtccaaattgattgctgcaacttcaccaaaagtgaagtggtacctgaaggggcgtgtccttgctgttctggccagggtctttcttctcactaccccttcccaactactctaccaacccatctcatcccatctccacctgcttcactgcaagttaccttaaggaaaattaatccacttctcctccccaaacaaggttatggaaatatagcctggtgtttctcaaactttaatattcatgaatcacctggggatcttgtcaaaatgcagatgtggacttagtaggttggggtaggcccaagaatctgcatttgtagccagctccctggtgttgctggttttgccagcactgatacacactttaagcagcaagggtcaacagtggatcgtgtggaacgagtcctggcctggggggaaggatttgtttttcaaacatcccagttctatgcagaagtgtgcaaaacacaccatagacatgagacagctcaatagatagaatttgatgttggagaagtctttcaacaagtgagtcattccttgtacttctaattattcacatgctatggttaaacatgttccagaaataacaagtcttctggcttgtgctctttagctactgactaattccaagccaagggctctgtatcattgtcctcataggaaaacaggaagagaaaaatcaacattaactgtctgcagtctggctactaggtcgtaggggtgtagcaaagaggagtaaattaatgaactactaactgactatgtaacagccaaagtgttacaaagggtgtaacaggcaccctcctgaacattcagaagagaaactgccatgagaaatgagaactgggctttcattgtgacgagggaatcatccttagccatggcaccaagggcaattctgggtggtcctttcatgggtcagtttcaaagcttagaaacatactcccaacctgcctactctcttttaaaaactcatggatttatataaactctgcttttctttgtaaaatctattttgagtttgtggatcttcattaactctttctatctttttttttgctggccagacatgcccataccacttaacaaaactcagcttctctcaggaagagaacaaaagccagaatcttcttctatcttttccctttttaaattacagtgtttaaaatgagaatctttatgtatccattcatccatccatccgtccgtccatatgtattcatcaacaatcggtgatgttcaacagaattttgtggcatgtggcgggcatattagggaaaagagaaagagcaaactgaggtaaaagagtagcccatcggccgggcgcggtggctcacgcctgtaatcccagcactttgggaagccaaggcgggcggatcatgaggtcaacagatcaagaccatcctggccagcatggtgaaaccccatctctactaaaaatacaaaaattagctgggcatagtggtgcacgcctgtagtcccagctactcgggaggctgaggcaggagaatcgcttgaacccagaagacagaggttgcagtgagctgagatcgcaccactgcactccagcctggcgacagagcgagactccgtctaaaaaaaaaaaaaaaaaaaaaaaaggcagcaaaacagcatcctggattcttgtctccatgtcaaccctctcaggatccagtacaatcacaggaatagagaaaagcaagtggactgaaccacatgaacctaggttctatagctgcccttactgtccaatagggaagccataagctaccccaactgaggtgtaactgtagaatacacactgtatttcaaagacttagtaccaaaaaaaaaaaatctcattaattttgttatattaattatataataaaatctttttttacatattgggttaaataatactgttttaaaaagtaatttcctttttctctttttacttcttttaacatggctactagaaaatttagaattacacatatggcttgcttcatctttctactgcacagagctgctctccatcttcctttcattcagagaaagaggccactttaaggacccttcactctgcaaccttagtttgctctttctcttttccctgatatgctcaccacatgccacaaaattctgttggacatcactgatcactgatggatggatggatggatggatggatggatgggtgcatggatggatgggtgcatggatggatggatgcacggatggatggatggatggatccataaatattctcagttttaaagtctgtaattaaagaagggaagagatagagaagattctgtcctttgttctctccctgacagaagctgtcgttaaatggtataggcacgtctggcccgcaaacaaaagatagaaagagttgatccacaaactcaaaggaggaatgtttggctctaccttaagctttctgatctaccagtacatgatagaacactatttaattaatagaaaggggccagacatggtggctcatgcctgtaatcccagctctttgggaggcccaggtgggtggatcgcttcagctcaggagtttgagaccagcctgggcaatgtggtgaaaccctgtccctaccaaaaacaaacaaaaattagccaggcatggtggcacacacctgtggtcccagctacttgggaggttgaggtggaagggaatgcataagcccaggagcaggaggctacagtgagctgagatcatgccactgcacttcagcctgggtgacagagtgagaccccatctcaaaaaaaaaaaaaaaaaaaagggaaccacaataaagagaattttatgtgtcttttgaaagtctacagctgaccatggcaataacattacataattctgatttaaaaaactaatctttggaaggaattctgtcaccagcggtgcatactggtgatgagcgccaagcttgggctgccccttatggaccttagctcgccatcaccctcatccatggctctggggagcaggctttactcattcctgccaatgctgattttaattttcacctcttgagtatcctcattctctggatcttttctctttcccaacactcctttacactctttaatctctcttttttccttctcttaaatcctttctctgtctacgtcctttaaaatttttataagtttcttgaattggcaagtggttcacatagctcaaaccatgcaagtttctaaagggtatacaggaagggtaggcccttctcccaacctcccagctcccctccctcaagacaaccattgttgacagtttcttgtgtatacttcgagggatatgtgataacatacccaaacaaatacaaatgtgcactctcttttgatccctcaaatggcagcatatattacaaacaatgttctgaaccttgtcttttgtaattaatgatacatcttggagaccattctctatcagtacaatcggtacatgaagcctcatttttattgctgtataatattctattatataaagaaccacaaattatttcaccagttgcctagtgatgaacacttaagttgtttccagtcttttgcattaccaaaattgacagaaataactttatacatgtattattttgtatacatttcagcatatctaaagaataaattcttttcagcagaactgctgagtcgaatggcatacatgtgtaagtttaacagattttgctgaaatgttcttcattaaaatgtactagttcatctcctaccagcaatgtatgagaacaactgtgtccctacttcctaccaatcaagcgtttaaaacatggtaagattctggccaatctgataggcaaaaaatagttttctaatgcagttttaatttgcatttttcttcttatcatgatggtgaacatactttcatgttttgtgagtaatttatatttccttttctatgagttgtctttcatgtcctttgtttattttccttttgggctgctgatctttttattgatttgtaggagttcattatatattaggcacatctaccttaaaatatgctattccttaatcccagcactttgggaggccgaggagggcagatcacctgaggtcaggagttcgagaccagactggccaacatagtgaaacccccgtctctactaaaaatacaaaaattagctgggcatggtggggcacacctgtaatcccagctactcaggaggctgaggcaggagaatctcttgaacccgggaggcagaggttgtggtgagccgagatcgcgccactgcactactccagcctgggcaacagagcaagactctgtctcaaaaaagaaaaaaaaaaaatatatacacacacacacacacacacacacacacacacacacacacacacacacacaaacacacatacatatgctattcctttccattccagatttcaagtttcacagttatagaagaaccagtgtcttttctgtggaagaaaaattcttttctaacagcaaatggagcctcttacatttcccataacataaggtatcataatgggccactgcccactcacctggactttggtccctcctccagacactctggagatgtagctcatgatatatttggcagccactgtttttccagcaccactttcaccactaaagaaagacagacaaagaatccacctgagaagtggattgcgaccagctcccttccttgtctcccccatcacacaaaacaaacaaacaaacaaaaaaacaaaaaaaacaggcagaaaagaatttttttttttaagtacaataccagtagagaaaggcaagttacagcaggattaggtcgcccatgtgacccgtgtgagccggattaacatggtgtggataattaccactgtgcacaccactgaccattaagcattttacatgcccaataatgggggatatgattaggaaaattatggagtatcacaagggtggaattctacataaattacaactgacatgaagactgtaaacacaggaaacaagcaaatgaaatcatgttaagtgaaataagtcattcaagttatatacaaaacatgattacaatttttttttcttaaaaaaaagactggaactaccacaaaatattaacaaaggctttggtcaagccagagactagagaaacttgttttaattcattagttttcaaacattttataatgcatatgctatttttgtaatttaaaaaaagaaaagaaaaagtgggcactctgaggtttcaaaccatgtgccttgaattgatgcaagcttccttattttagaagttctaaaattaaaccttgaagcaatattaatcacatccggagtaacaaaggccaccttccgctgggtagccttcctgcatggggagagccttttgttaataatatatagtctgctcttcaaaatccccattcttcctacaaaatccccctgaattgataatgacctcaattcaaaacatgcttaagtcagtcagatttttcatctttctattggtaccctttgtgttaccaggatagaattaaagaaccccatatcatataaaatgatggtgggagttagtatgaaaaatgcagactgctacaagttcataggacaatatttttgttcgcgcttcgcgataaaaaattttagggcgcagagcaaatgttcttctatgaatatccagcccaaattaattgttatcgattgctgagttactcaaggaaagagaaaacatttgcttggggaacaaccaagcaaggtgacactcctattcccaaaaggaaactgaaatttgaaataattttacatttcaaaacaaaacaaaagaaacaaatgaacagagaattgagctggccatatagcgaaactcagaactttgctgaatttccttgaactaataatacggttttaaagaaattatggggaggcgggaaccatcctctgttcagagctcatgacctgcaaaagtctgaacccacctatgcaagtcactcaccatcctagtgctatgctcctggcttcctggtcacatgaataagaaaaccaaactgaaatttcgtaagctacagtagcaagtagaaaaccagcaagcctgggacgaggtgtcacactcttccagaggacatgcttactcacaggcagcaactaggtcgggcaaattcaactccatggggaaattatcttttcaaatggttgacatactcagatgatgtatttactagatccagggtcaacacacacactctctcattggaattacacggtttggcaacaatgaaactccattttagaagttgtaaacaatgtaaacattcaagaatattggaaagtccaagcttacaatggcacaaccacccaatataatactgcacaggcatttgaagtacttacaaagagtatgtagcaacataaagataatgcagcctaagttaagtggtaatgtgaatagaagatactatatttataacaagtttacaactatgtgaaaataatgtatgggcaaaaacaaattgacaaggaaaaagaaatattccttacttgttaggaggctggtataggaatggtttttttgaaatggagtctcactttgtcacccaggctggagtgcagtggcacaatcttggctcactgcaatctctacctcctaggttcaaatgattctcctgcctcagcctcccaagtatctgggattacaggtgtgcaccaccatgcctagctaattttttaatttttagtagagacggggtttcaccatgttagccagactggtcccaactcctgaccccaggtgatccgcctgccttggcctcccaaagtgctgggattacaggtgtgagccacgacacctggctctttttccttttcatgtgctttctcataattttctattttttttagatttttatgccgggtacaatggctcgtgcctgtaatcctagcactttgggaggccaaggtggacggatcatttgaggtcaggagttcgagaccagcctggccaacatggtgaatccccgtctctactaaaaatacaaaaactagctgggcgtgatggcaggtgcctgtaatcccagctactcaggaggctgaggcaggagaatctcttgaacccgggaggcagaggttgcattgagccaagattgtgccactgcactccatcctgggcaacaagaatgaaactgtgtcaaaaaatatatatatatatattttttttattttttaaaatttgtgtatttcagattttttaaaacagcttttccagagaaaagggagggatcacacctcacaataatcaccactgatcaatttcattacattattattattcaacttcctacatatcaccataagtatgtatattttccttaagtttacactgtcacatttaaactttactagaacaagctgggaaagagagagagagcaagcgtgagcaaaccctataagaattataaaataatatatataaaggggaatttattaaatttaaaaaagaattataaaaggacagtaatcccagtaatcctcccactgtgtctttggttaatactgtattcagacatgaaatattttgtctcttttgttggaaacaaaagcaagtaataataatggaaagtagctcttttaatatatcaaaataagtataccagttccaaaaataggatatctgcattctcagcaactatgatcttttccagcagacttaaaataattagttctcactaaacattgatcggaattttcattacttggtttcaatttacagacacttaagaagaatttttattgatcagaggctggtgagttggtcaaaatatggtacaataatggaatgttacagaatgacttgaaacctacagtatatgcaaccataattatgctggcctgtttgggatgagaacatattgtttcttctccggcactaaaacccaagttaaaagaaagtgaaggtcttagacaaaataatatatcccaaattatttactttgcatctcacagcagttattgtacagcaatttgctttgtttacgcttccaggcagcccgtcctaatttaattgacttataaaatggacacacacacacaaatactctagaaattaggaaaatatcccagtggttcccaaatctggcagtctatcagaatcgtcagagtactttttaattgcccatgtctgggcccgtcttctgacctgctggatcccagtctccagggacagagtctaggaataggaatttctaacaaactccctagttcttgtatagccagctgggaacaagccaagcaattttaaatcaaagtcataacagactttataggaaatattaattcaaataggaagtattgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccataattatttttctgagaaaggttattcctcacttaaaagtcaatagtattttctattcacttcaacttattcagcaaatgtaaaaatatttcagttcttttttattttgattttttgagatattccctaaaataagtaggatccgctgttaccactgttggacgactcaccaatgcacccccatcccccatttctgatctaaaaatctctctcctggctctgtaccacaggaactggtgttcccttgtaactggctgaatcaacgtaattgaaatatcacttttccaactttttgtttgtggtttaaaaaggacaaacacttaaaacaaaaatgatgtctacttttgttcatgcaacacacactgtctaacaaccccctctgccccagtgtgttaagccgaaggccagaatgagatgtggctcctgtcagagaagagctcactcactgtcttacagggaagtcgagtatacaaaggctattaataacacagtggagatgtgggtatggctttagggatttgggggtggcagctatccctgatcagaagattactaaacgaagtcacaactagttacatctcaataaggacaatcaaatcagccaggtgtgttgcgtgtgtgtatgtgtacttgtgtgtatacatgtcaggggctgggatgaagcctgagccatacataagaggcaaaaattctgtggggtacacatgaagggaaccatgggtagttaaacaggacttgaggagacagtggctcacacctgtaatctcagcaatgtgggaggccacgggagttggagaaccagccttagcaaacagcaagatctcgtttcttaaaaagaacaaaaacaaaaccccaaaacacaaaagaaacaacaactataataataaaacaaataaaaataaaaacaattggctgggtgcagtggctcacgcctataatcccagcactttgggaggccaaggcgggtggatcaccttaagtcaggagttcaagagcagcaagagcagcctggccgacatggtaaaaccccgtctctactaaaaacacaaaaaaattagccaggtgtggtggcatgcgcctgtagtcccagctgctcaagagatccgaggcaggagaatcacttgaacctaggggacagaggttgcagtgagctgagactgcacgactgcactccagcctcggtgacagagcaagactccatctcaaaaataaatagataaataaataaaaataaaaataaaaatttttaaataaaaacaattaaaaataattagctgggtgtggtagtgtgctcctgtggtcctagttactttggaggctgaggtgggaggattgtttgagtccaggaggttgaggctgcagtgagctattgttgagctactgcactccagcctgggtaacaaagtgagatcctgtctctaaaaaataaaataaaataaaataaaataaacaagtaaataaataataggccttgactgtgatgtgggaagctgggaggggtagggagtggagctggaaggcagtgcagagatccaagacagtgaccttgggttcaggtttggggatgcaccaagggttctggcctgtgccatttcgtgctacattttatatagactctagacttccattttctcaaggcagcataccgacaaacttgcctttacctatacagaacaactgatatattatttacttagttttcaaaattgacacactttttgttggtctctgaatactattcttcaataaaaagaacaagggctgctttgggaaatgaccaatgccagggctggagtggggaaaattcaaactgggcgtggaacatataactgtgccaaaaggtaaggaaatgtacagtgactggtgtggacgtgtcaagcatataagagccagctggaaggggttcccactggccaaatcaaaataagtaatgataataatggattacgatcctttgaataaaataggaagccataattccatagtgccatacgaaagtaaacgagtcaatcagtaaataggagagaaaggaaagctcttcctcacagtggaataccaactaataaatgtggaaggaatgatggaaacagatatatcaccatttggcagccatcatacaggtgtccaggagtcattaatggatgctaaggctggtaggtggaggtttggatgtggagaaggatgttgtcatgatctgagaatatatccccacaaaatacacatcctaaaagaaaataaaattaatttaatgagaagaaacctagcagatgcctacagaaccaggtgatcaagagccctgcattgtttctatggtagtccagcctagaatgcatgacctgagcctggtcacgaggaaatgggtagactcagcctgaagtcatcccacaaaatttaatgcctgaactctttaaagctgtaaagggcaaaaaacatggcaaacacagagaacaagatagaaaagtcagagaggtacacagagaagcaggaagatgcatgtggcttcatgggggccaacggagttgggattaaccatgtcaatgtgtcagggagataaacaagacagtggaaattcccactggacttatttaattagaccctgcttttttttttttttttcaaatatagagagatatagtattgaacacaactcttatttcaaaaggtataacccaaggattaaaaatatagtgatagtttttaaaaaccaatttttgtaattctagagttataaaagatgaacgcagttgttcatctattaaaacatagtctagacgatgagaaataacatcaattccaaaggaggcttgaaaggaacacactgaaatattgtggctatgataattggaggtacgatgtgttcattgtgtgtatcatgcatgtcagagactgttataagtgctttacatgtgtcaatcacttggtccacataagagtcctgtgtggtaggtgcttttataatctccattatttgaagtgagaaaaggtaagaaacttgctgaaggacacttagctagtgagtggaagagctagaaaaggaggtgagagagtctgtgtcaggggcaagagctctactgctcagaggacggtaaacctttaagaccctcatatgggttgactagtcaataaaaatcaacaaggtttcacaaaggaaccccatgaacagcacagttcatagtatcagcaaacttttagctactcctgagtctttactgatacacacccatttaagcaagccttctgccaacaacatttattacctcacgcagagttggaactaacaaataataaatagcctacatcactgtgatcataagacaaagtaattctgcgagaatgagaaaccacatcaaagaaggtcctggacagtcttctccaatggctcaattcacagactccgcttcctggcagccctactagatctggaacagaaacaagtcggaggtgaagcacatctgggaggttccagggtcatggagagaggggtcctccatcggactttagaattacactaaaaaactaattctcaaatacatgccatggctaatggtataaaagacaaaaacaaacagccatgctgaaaccactggctaaataagacaaattcattccttaacagattgaggaaagtgtgaataagaccaacagctgttatttcttcccaaccccagacaaatatctagttaattggtgttgtcaagcaaacaaaattttcacctactctgccaagaatatggatggccccatggcaatgctcatcttggcccagcctgatgcagtcagaggaacccaatgttgagtatgaagaccaagtttgagtcccagcccagctacttcccagctctgaaattcctttgaatgttactagcagatcttttacattactctttaagagttaaaaaatgttttccatgtatatttcctcattacactttctttatattcctttaaggtataaattcccaatttatagatgaagtaactgaggcttgcaggggtcacacgccttagacagagagaatagagtctaccctatgactcaccccagaggtctttccactgcacctcatgactgaaagtggtaatggattattaaccagttaacctaacacctgctggctcaaagcagcagagaaaagtataaagactgctgtatcggaggcgggcagctctggctgggagcacaactttgtcacatttcaaatgcaagattttaacagtttcattacctctttgagactcagtttcttgatctgcaaaagtaggggacagcaatacctagtttgctaggctgacgtaaagatgaaaaatgatacaattaaaaggatgcaaagcaagtactcgaaaaagagttgctgttatgtttatgggtaatatattaattaggcagccctcctgaatagcactccttggctgatgataaaggaattttagcaaccagactagaatgtaagatttgcagaaagcttggggaacagggtcaatctaggcccttgctcttcagatttacagccagcggcagccccatgcaaccccgtcatagtcagaggtatgggctgacagggcctcccaaagccaggccagggggatggcgaggtcaaaggccggtgctgctgggataaacaagaaattgggtggacccacagcaactcaggagagccctgaaaagcgtccccatgctaataataaaaggttcctgaaatacatcaaaggcaggaagatagcttgagaatccggagacacctgatggtgccacagcaaagagcacgagagacccacgagccaaatatgagcggcactgggaatttttcccttttatctttactactgcaaaaattacatatttcaaatctaaaatatatgttgaagcacacgggtcagaaatcttagctccagtgatgactactatctccttttcctctatgaaaactctcttactcaatcagtcagcaaatcccactgatgtaccttcaaaatatctctcgcctctatttattatttaaaaaagtatttatttagcttctatgcaggatgcacctgacaaagactttgcaaactggtattggatatatttaggacagatggtctactcaccagaaaacaactgcgtcaggatacttcaaataaaaaaagtagaaacagcaccaaatgggatgctttccaattgacatcatattttttaaacagcctaaggtgcaagagctgatttaggccaaaagtgataagaattcacttttgatggcagcaataaaactgccacataaatgttctccaaggcccgatgattctccatgggtcagttggcaagggcttcagaaatgcctctggccacattgtcaagatcttgtctggtgatggagagatggtagagatcatgaacaaagcttgccagttcttcctttaccacatcatgacctttttgttaaacagatttgcagagatgtctcttgacatccaaaggtatcacatatgtggttttaatgcacaaatccaaattctggattttggagaacagattaatgagctaagcagatatgggtggctcatttactgggctcacaggtacctaccaagccttcaggtgctcattatcattctttttttaaattttttaaatttttaatctttttttattttttgagatagagtcttgctctgtcatccaggctggagtgcagtggtgccatcttggctcactgcaacctctgcctcctgggttcaagtgattctcctgcctcagctttccaagtagctgggattacaggtgcctgccaccacacccagctaatttttatatttttagtagagatggggtttcaccatgttggccaggctggtctcgaactcctgacctcaggtgatctgcccacctgctgggattacaggcgtgagccaccatgcccagcttcactatcattcttaatgatgctaatgtagctattgctgttgcatttttctgttggcactgcccagagtctaccttcacacttgcccattcctttatttctttacaggcttactgaaagtcatacgtcggcttcctcctcgcctttctaactcaggtcaggccctcactgctgcaatagatttccatattccctcaacatcccatctcttttctaccaataaccttatctttttgaaccaggtgtcagtgctatcatgtctctgctcagaggcctgctataatatagaaataggccatagagaaccatgaaaagaaggggaagactgagctctggcccccagacaaatccactggataacaagtcaggtaaaatacagaaactgcccaggtatggccatttggtgtataaatgcatcttcacctcttggtaagaaatcaaagctaatgtgtcaataaggtcatgttcttctgttaactaagtctgtgcgtcatttatcctccgttgatgacaagcccaatcatcatcctcctgggtatgcagagagcatcacggccaacaatgacaaagggttagttttaaaaagcacctgagtccagcctgggcaacataagaagaccctgtcgctacaaaaaatttaaaaattagccaggcatgatggtgcgcatctgtggtcccagctactcgcgaggctgaggtgggaggatcgcttgagcctgagaggcggaggttgcagtgtgttgaaattgtgccactgcactccagcctaggtgacagagcgagactctttttcaaaaactaaaataaaaaagcacctgtatttgtggggacagagtgagagactttaatcctaggagctcaagtccaggggtaactaacctggcgaacctgtcctgacctctgtcctatggtatatggtagctattacatctccattaaaatatgggaaatttgagacctagagagacatcactgctaataggtataaagaaagtgcataaggtttgaagtcagacagggctaaattcaaatagaggctctgccatctactagttttggatcttggaattctcttaagcctcattttttagatgcagcttcaaaaaacaatgccaacagagtggtaaggattaagagacaacctatacgaaagcaaccagcagagggcaggcactcaggaagtctatcttgcggggtctgatggtgctaacagcaagaggtgacctgaaatcaggatttcaagagccttagccctggcttttaagcagagtgagctgggggagcttgaaaaaaggtattaatgctccaaggccaccacaaatcagttgaaacagaatctctggaggtggagcctacatatctgtagagccactgaactagtaaggcaattcaggaatcagaaatacttatccctagaaagttaaattggtgaacctaggccagccatggcagctcacgcctataatcagagcactttgggaggctgaggcaggcagatcacttgaggtcaggggttcaagaccagcctggccaacagggcgaaaccccttctatactaaaaaatacaaacaaaaaattagccaggtgtcatggcacacccctgtaatcccagctactcagaaggctgaggcaagagaatcacttgaacccaggaagcacaggttgtggtgagccaagagtgtgccactgcactccagcttgggtgacagaatgagactccgtctcaaaaaaaaaaaaaaaaaaaaaaaaaaagataaattagtgaacacaaggcatggtagataaaattagcatctataggccgggtgcggtggctcataactgtaatcctagcattttgggcggccaaggcaggtggatcacttgaggtctggagctcataaccagcctggccaacatggtgaaaccctgtctctactaaaaatacaaaaaaattagccaggcaaggtggtgggcgcctgtagtcccagctacttgggatgctgaggcaggagaatcgcttgaacccggggggatggaggttgcagtgagccgagatcacaccactgaactccagcctgaacgacagggtgagactccatctcaaaaaaaaaaaaaaaaaaaaaaaagttagcatccatagaagccactcttcctgatttgtctgccagtgggctgaggaggaaggcataggaaatatccaaggtcaaccccaggtgtttattccttactagaagttggcctaatagacatcagggcttggcaggagagagtgtaggttaatgaaagggggttgacttacagcagagtcaggacaggaaagtaaacagcagagatggggggttttctccaagtaaaaagactgttctgcagactagagcaacacccttagttcatgtgttcacatcttcagatagaggtgactgctgtgagctgatttagcaaatacgatcatcccttcgctcagaattcacccctctatccagcgttctcgtggtaatctagctcccttcgtggactgtgttccagggcacataatcggctgtccacaggcagaattctgcctatgcaataatgaattggggtctgattcacacttccttgtgagtttgcttggcaagtcagtctacccaaggctgctcaactccagctgttttgacaaatcaagtttgtagatggacctaggcttccatggagccctgtgcttgagaaagcagcacgtctccttccttgatttatttctttcaaaatccactttgtggccaggcgcggtggctcacgcctgtaatcccagcactttgggaggctgaggcgggtggatcacgagatcaagagatcaagaccaccctggccaacatggtgaaacccagtctctactaaaaatacaaaaaaaattagctgggtgtggtggcaggtgcctgtagtcccagctactcagaaggctgaggcaagaaaatcacttgtacctgggaggcagaggttgcagtgagctgagatcacgccattgcactccagcctggtgacagagcaagactctgtctcaaaaaaaaaaaaaaaatccgatttgttacactcatttctagtcttgaaatggtcaggtgcctgtccatcctgtcaccgtatccactgcgttggaaaatatgagtaagactgacaggaaactagaaacgccgcctttatgggctgcattatgccatctaaagtgtcatttagacaaagtcacaccagggaaactgggaggtggaagtctaaaacaccaccatagaaattaggtcatcgctcactttttatttcctaattaaatgacactaaagattcctagtctttccagccatgccagaatcccttagcatgaggagcaggcttctcttccagcctccaagaaaatggttttttcgtttgttttctgctcacaaacacattttaaaaggcaccattcaactcggcccctaacagatggagcacctgccccatccagtgtcaggggctacaaacttggcctttccacccagaacaggatttccctgcctttcctcctctccaacattatttggaaggaagagttccaaaaccagttccttcacaggtgaaaaagccaaggcccagacaggtgtgaggcgtgctgcccagggtcaggtgagcatgaaccacggcatgccagaggtttccaatttgctttctcaaagcagacaaaccacagccctggtgcagaagagaattaactcaagggctcaggcttttgccctcggtgactgggcggtgatgtctatgcccctggaatgtcctacctaagaggagtgcttttcctttcttgggggctttgaccataggagagtctgacgatatgatttatgtcgggggctttgggacataccatcgcaattctgacctccaactggaaactaaaggcatttgcacaagccttcgagagcagctggaaactgaaggtgggccaggcaggcggtgcgtgatcgaggccaaacatcagaggctcaggtgatgttttctggtcggcaatactgtgagtattgtcacacctcataccggtaggaggtagcgctgtccatgactccacagggagaggaaaaccagaaactccacctcgggaccctcccagacctcgccctcaacctcttttgtttggctttaatttgtatcctccttttgccagaacgaaactgtaatcctaagtgtagggcttttctgagttttgtgagttgttctagtgaactactgaacctggcgggggcggggggtagtgggaacccctgaattgatgagggtggcctggggagccctgaacatgcagctgatgtctgcagggtgggcagtctaccgaggaggcctgtgtccttaacctggagtttggcccaactccaggtagctcctaaattaaagcacatctcctaaatgaaaacacagccactgcaacagaaatccttgggagcaggtccttgaaatctctgccacctgaacagctggaaacaaggatctgaagtgggcatcatcccgcttcagtgcaggtggaccttgcagtgcaggtggagggagacacgtgggctgcagaagactgagggggcctccagactagcaagctcatgtaagaagaccattcccatcccactcgttttggcacacacccagaagagggaaaatgtgaggaaagagaaagggcagaggactctatcagaaaactcatcctggaccctcattaaattccagctaggaaaatacctcctgcctctctagtagtcggtgacctccgcttagtatcaaacagaagcatttcctattaagcaaccaaattcaacatgacccaggtgttcctcctcataaaatttaacttgcacctgcatctgatcaagtcattagatataaccttaaacttgtagaaaatccaactgaaggaataagtatagtgagaccaggaagaagcaattagacaaatgtaaatgatgtctgtaggaaaactagttttggtctcttcaaaaagtcagtgtcatgaaaaaaaacagcagtaatagggcaattgtggtaggataaaaataaatttatgattcataaccaaatgcagtcagcgttacttgatttgcataaaccagcagaaaaggacgtttgcgactattagagaagtttgaagtttttagatgatgttgaaaatgtactattaattactgagttatgataatggtcttcggatcagtaagaaaatgtttcaatttctcagagatgcatgtggaaatatttaggggtaaaatgtcatgaagtctatatttacctccaaatacttcagatatgtatttaccttgaaatgcttcagtgctcatgttttgcagtactgacttgggaaccatgtaaatgttttgcataattataaaaacaaaattacatttaaaaatgcaaaacaactgaaattgtaaatgaaataaatgaacccaactgtaggtcaggttgacatagaaaaggattattttaagtgacttttatgaaacccagtattttgactgcaaatattggatatttggacaaaaaccagaaaagaaattttaaaatgaattcagtattgctactaataatattggtattgttactttaacagcattaacaaacttattctatctgtctaaaacgcatacaatgcaatgcaaataattgctaatgtaatcaggaactaagattgttcagcataagataaatgggatacaaaaattaaaatcaaagaaataaaaactctgaaatcttaaaaattaattgaaaacagttaatttttcaacttcatttttctcttaaaaagctcatattccctagctttgtacttttaaagaactataggcactgaaaacacagggcagtgagcactcttggtgtctagtttagtggtctcttaatgccatttcccattaaaatgaaccaaggcctagcggggtgcggtgcctcgtgcctgtaatcccagcactttcggaagctgaggtaggcagataacttgaggtcaggagttcaagaccagcctggctaacatggtgaaaccctgtctactaaaaatgcaaaagaggctgggtgcagtggctcatgcctgtaatcctagcaatttgggaggctaagacaggcggattacctgaggtcaggagtttgagaccagcctggccaacatggggaaaccccgtctctactgaaaatacaaaaattagccagatgtggtggcgtgtgcctgtaatcccagctactcgggaggctgaggcaggagaactgcttgaacccaggaggcggaggttgcaatgagccaagatcgtgccactgcactccagcctgggcgacagagtgagactctgtctcaaaaaaaaaaaaaagcgaaagaattagccaggcatggtggtgcatgccttaaccccagccactcaggaggctgaggcaggagaatcgcttgaacccaggaggcggaggttgcggtgagctgagatcacaccactgcactccagcctggatgacagaatgagacttggtctcaaaagaaaaggaaaagcaaaggaaaaagaaaagaaccaaggcccctgaagagactgtggattctacgcaggaaatatacaagatgagctagaagatcttaaagaaggaaaccaacagagcctactgcggtcatgtccaaaggacataagagctaagaaaaaagagtgtcactgttcaacaacaggatcatttcagccttgaaaagtataactgcaatgtaaacaggtacaatattaaaagtccactagtttgagtaatactgaaaataaaacacatcaccttgggagactgctagggcaacaattaattgttttgaaaataggtgagtaatggcagtgaatccagtgttttgtctaattttcccacatagtttttatttgaaggtgaccaagcaaaagaactaataactgcagaaaaataatagaattagaaaacaacgatttttcaaccactaattaaacaatggctctgaaatgatttataacagacgggttcactgacaatctggacacacgaagagagagcaacaggcatgaagtgcacagcatcactgatgaagtttcctttgccaaaaacggaatctgagtctgatcgagtttttttttttttttttttgagacagagtctcactctgtcgccaggcttgagtgcagtggcgcaatctcagctcactgaaaactctgcttcctgggttcaagcgatttccctgcctcagcctcccaagtagctgggactacaggcatgcgccgccatgcccggctaattttttgtattttagtagagatggggtttcaccatgttggccaggatggtcttgatctcctgacctcgtaatctgcccacccaagagtgctgggatcacaggtgtgaaccaccactcccggcgtctaatgaagtttttagatataactattaatttacagaaaatgtaggggacaatggaatacttaagcaacatcataggatacaattaggcaatgccagactgtatagtaagatctacaggacaaacaaccttttttttttttttttaacaaagccaagaaaacaaaaaggggaagggaaaattgttaaagaccgagacacctaagagacacagcaaccaggtgcggtgtgtaggccttgtttggatcctaaataaaaataaaccaactataaaaaagaatttataggaaaatcatggaattggaatactgatattagatactataaaagaattcttcctgtttaaggtgtgataagaatgatttcttagaggcacatactaattattgaggaataaaggggatctttgggtttgctttattaaaaaaacaaaacaaaacaaaacaccatctctgtcgcctggctagagtgcagtggttcaagcacagctcactgtaatctcaaactcctgagctcaagcgatctccctgcctcagcctccctagtagctagggctacaggtgtgcaccaccacacccagctaattaaaaaaacttttttatggagacagggtttgctatgttgtccgggctgatctccaattcctggcctcaagtgatcctcctgccccctggcttcccaaagtgctagtattacatatactcttttcttgaccttggaaatgaatctactgccatgccctgccagatttgctttaagtaatcaagtgggacagaatgggaggaccaaataaaacagaattggccatatactgacaacagtgcaaaatggataatagatatacagggacacattctactattctttctcattttgtgtatatttgtaattatccacaataaaaggttttttttttcccaaaaatgtctcagaaaaattaactaaaaaagatgaacacaaatacgtatgataagattgtgaactgtcaaattctaggtgatgagaatatggatgcttatactttctagtgtttgaaaatattcacaatagtaagcagagcttttttttttcttgatatggagtctcagtctgtcgcccaggctggactgcagtggcgtgatcttggctcactgcagcttccgcctcctgggttcaagtgattctcctgcctcagcctcctgagtatctgggactacaggcatgtaccaccacacctggctaatttttgtatttttagtagagacagggtttccccatgttgccaaggctggtcttgaactcctgacttcaagtgatctgcctgtctcagcctccactaaggtataagcctttttttttggtttggtttggtttggtttttttgagacagggtcttgctctgttacccaggctggaatgcaatggcacaatctcagctcaatgcagccttgacttccctggctcaagtgatcctccccactcagcctcctcagtagctgggactacagacaaatgacaccagacgcctggctaatttttatatttttttgtagagatggggtttcgccatgttgcccaggctggtctcaaactctgcggcttacaggtgtgagccaccccaactggagttagtaagcagaattttattttattattttttttcaagatggagtctcactctgtcactcaggctggagtacagtggcacgatctcagctcactgcaacctcctcatcccaggctcaagcgattctcccacctcagtctccctagtatctgggattagaggcgtgcgccaccatgcccagctaatttttgtaaataagcagaattttaaaagcacttaaggcaggagtatccaatcttttggcttccctgggccacactggaagaagaagaattgtcttgggccacacataaaatacactaacacaaacgatagctgaagagcttaaaaaaaattgcaaaaaaatctcataatgttttaagaaagtttacgaatttgctttgggccacactgaaagctgtcctaggccgcatgtggcccatggcctgcagcccacaggttggacaagcttgacttaaacccagccaggattcagagccatgtcagactagagggattatgaaatgtggctacagacacctaatgctggcaattaccagtaatcttcccccaaattcaatgcaaatgacaaagttcaccaaaaatgttcaaacatgaactactaaattatgaagggaatgaaaaaatagggacctacagaaaaggaattcatctgactaaacagtgaaaacatgtttattatacttactgcaatcccatggaagctcaaaagttttatgatatggagctctattatatagagttataaataaagcaagataaagcagctaacctgcttgctactcagacacattaaccaggctgtgacatcagtagctgttgcaaaaccactgcttatcgaccgaaatccataaccacagcatagtctcatatcttccacgcccactgataaggatcttcttcatacctgataatgacgcactggttctctctgtcaatgatcatgtttctgtacatattatctgcaagggcatagatatgtggtgggttttcatactgtgcctagaaaagcaaaaaataataatacataaataataataaaaatttaaaaataaaaacaaaatcatggtcagataggcaatacactcaatttcttttcctgaatttggaaacgaatcgtgcactatagttccaatgcctatcattacatcttaaaggttgcatgatacaagaattcataaaacttcctaggtcatcaaggttacaccctcacaaaattaagacggaatttggaagcagtctcccgtaggcatatccatgattcagccttccggatgtgccccgtgtctttagacactccaacaccccacccttccacccatacacgcctctgcaggtgacagtccatttctaaatgtttctgtagacacttgggcaacaggtctttggagaggcctgccaaacacctagatctgacttctaccagaattctaaactcttacataattttttctaagaggccacgttgtagattctggggcctcagagggaattaggtgagattatctatggatcagaaaaaatacttaaatctttccataagaagagggcaagaaggtgtggttctttaaagggataagctagtttggccagtttgtttcatctctattggaaaaaaaaatcctaccacgctaagatattctcctgggtttgtgatttcatcttatgggatatcttagctatgcacaaatatcaaactaaatacattttccatgcttaataaattatcaggctgacttcagccctgctttatacaatttcttgacacctacctttaccacaacctcaaaaattactaaaaagagaaatactttgttgagtatatatggagaaagaacactcctagcctgtaatcactccaagctacttggtaggctgaggcagaagagttgtttaaccctaggacttggagtctagtctccacacacacacacaaatttaattagctgggtgtggtagcacatgcctgcagtcctagctacttgggaggctgaggtgggaggacagcttgagtccaggagttggaggacgcagtgagctacaattgtgggaataatagcgtccaagctgcaagtctcacagtgtaaatgacggatgggaaagcaatttgaaaagacagagtgatatacaaaggtgaagcttaacgtacttaatccatctttggattaatttacttaatccatttcattgtgcagtgacttactgtagaaaagggggcctggctgagaagttgctgctcactgccatgctctggaagatgagagtttggtggggaggggttaggatgagggggctttgtatccgatacccagtgttcttcccatgctgtaggcagggggctcatagggggagctacccagtgagggctgcaagctatgcctaggactggtcacctaaagaaccctatgcaggaaccagaatatgtgatctctgccttaaccttatggttaggagtggatacctggataggacctcaggatatggttttaaatggacttctagtccacaataagattgtgcaggattattataattattattttaatttaacagagtttaactgagcaaagaatgcttcgtgaataaggccgccctggaacaagaatagattcacagagcctccagtgctgccatatgccataagatttttgggcagaaaaaggaaagtgatatacagaaaatggaagtgagggctggccctggctcaggcctgtaatctcagcactttgggaggctgaggtgggaggatcacttgaggtcaggagtccgagaccagtctggccaacgtggcaaaacccagtatctactaaaaacacaaaaattagccaggcgtgttggcagatgcctgtaatcccagctactcaggaggctgaggcaggagaattgcttgaatccaggaggtggaggttgcagtgagctgagattgcagtattgcactccagtctggtgaagagcgagactccgtctcaaaacaaaacaaacaaacaaaaaaatatatatctagaaaatggaagtgaggtacagaaacagccagattagttacagattagtttagaatttgccttatttgaacacagtttgaatagttggccacctttgattggccaaaactcagtgactggcagaaaagtaggttatagtttgtttatacatctggttaggctacagttcactgtgcacagagaaacatttagcgctgggtgtgatggctaatgcctgtaatcccagcactttctgaggcaaggccagaggatcactcgaacccagcagttccagatcaacctgggcaacatagtgagacctcctctctacaaaaaagaaacaaaattagctggacatggtggtgtgtgcctgtagtcccagctatttgcttgggaagctgcggtcgggggatcgcttgagtcctggaggtggaggttcctgtgagccaagatcacagcactgcgcttcagcatgggtgacagagtgagactttgtttcaaaagaaaaaaaaaaaagaagaaaacatttagatccaacttaaaatatgtaaggaggcagctttaggctaaacttaatttaacaattcccctctcttgtttttttttgtttttgtttttaaatagagacagggtctcaccatgttgcccaggctggtcttgaactcctgggctccagtgatcctcccaccttggcttcccaatgtgctgggattataggcatgagccaccatgcccagtccaatttccctcttttggtcatcctctcaattttgagacactgaccaaaactttaggcactgatgtcactctgtcaccattgtaaaaatgtacttacttgttctcaaatatcattgagaaataacagaacagtagggtttgtaagattggaacaaagactctaggttactttttgtaagggttagagtagagcggacctcctcctgctggcatctcctggtctgtttctttaaagtttcgattatgtcacatgtaacatgagtgattccatgttggtttggtttggtctggtctgttaggggctactgcatgagatcagtccaaaacaatggactctcataattttgtttaaaaattcccctctttaggtcaggttctcacttaggtgagagtgtcaccaaaacttagcccttagcacccctctcagttaccctcattttgggtttctggtctcaagtgcacaaacaacattaatgactctttgaaaatgagaaagtagaggactgtaagaaagacacgaagatggaaaatggaaggaaatggagtgaaaagcaagctatgggcagtgggggaaagtcattgcccagtaaggcttcaacgctgctgaactgtcatacttgacctttgcatgtcactctatattttccaaactcgtttcctatctgtggtcttactgaacctctcagctatctgtgacaaaactatagagtgggcatttcctttacctgattcttccctcccctgagactctcaaagtcattaggacctgacttcaactcctagctccatcactcagtagattttagtacttcatctctctgagcctcagtttcctcatctgtgaaatggagatagatgttatgacacagccagcatccagggctgttttattattgctgcaagtataacatagtacatggcactcagtaaataccagttttacaataatctgttactattagcagtaaaattgagcatattttttagaaattctacatttccttaaagagaacacttcaaaagataaatggtctaaaagggatgtgtatacagcaacccttttcagaaaactggagagaaacacacatgcacagcactaccatctacagcgccttggctgtcattgaggacgccaagccagctctgtgcgcctgctgatcagggcactagggcagggccagcctctgctgacagtgtttcccttgtgctgggctcccataaaggcagcattatcaaaggtctttcgcgtggcagcctccttcggctccagctaccagcaccattcatctggcaacaatggggtgggctcttgctctgggtaaattgccttccacttcaactgatgaatttgtgtgggctctcttttgtttgctttttaggggtcaggattaatgaatactcttgtgcttctgctgcagtgggaaggaaaaggaaaggaaaaagatgcagagatggggaggcctggggaagtgatgaaccacagaataaaatatattaaggagaattacagcttccatttttactatacaactgaaatggctatggagctgattatgaataggaaccagggtcaaattaataaatgaagtaatacaagattcatttttcatgttgaagtcatagtcatagtttaacaatggttctgattctgcaaatcagtacccattgctctatttttttacccataactgatttttattccttagatttttgtggcatatatggaagcaggaagatccctaagctgtaggtcctacatcctatttaactaattttctatgcaaataaggctcaaatattagacagtcctaagcttttttgagctctgctctaaaaagcagatcattggccaggcgtggtggctcaccagcactttgggaggctgaggcaggtggatcacctgaggtcaggcgttcaagactagcctgaccaacatggtgaaataccgtctctactaaaaatacaaaattagccaggtgtggtggtgcatgcctgtaatctcagctacttgggaggctgaggcaggagaattgtttgaacccggaaggcggaggttgcagtgagcggagatcatgcccagcctgggcaacaagagcaaaattctgtctcaaaaaaaataataataataaaataaaaataaaataataaaaattaaaaaataaaaataaaaagcagatcattaaaaatcaaacaatgtcactcaagtttctccaataaaaaattcataatagaaaagtgcaaaagtactgctaacttcaagaaaaaccatgtctgcatcataaaagccctaaataaggcagtaatttatgtgacacgtaacttaccgctccttggtacatttcaatttccttttccccaaaatatggcatctgcttgaaagggttgactgagattaatacagatcctatatatgtctgaatttaactcagttaaggtccatcattaatattcatagctacacatttttcaaattaagtaaccagatgttatcaagaattcacaatgactgtccaagtggaaagtttgtgtacttgttttctaaaagattacaagtaaagacgaaagcaatcatccaactagcacaggctttattcctcctaaggaagagtaataaattaccaaggtgctacaaaatgaaatcattattttaaatgaactaaagcacattctttcaagatgggtgacacgtacagcaaggagaaaagaaaacaaaggaaaaatggccaaagagtgaaaaaagcagttatcagtcctcccctcaaatgatatgcattttttcctttgaactttcgtatccgttaggtacactaaaaacatattcatcagccgggcgtgatggctcatgcctgtaatcccagcactttgggaggctgaggtggggagatcatttgaggtcaggagctcgagactagcctggccgacatggtgaaactccgtctctactaaaaatacaaaaattagccagctgtggtggcacacgcctgtagtccctgctactgtactcaggaggctgaggcaggagaatcgtctgaacccatgaggcggaggttgcagtgagccaagatcatgtcactgcactccagcctgggcaacatagtgagactcttgtctccaaaaaaaaaataaaaaaaaatattcatctacttatttaacaaatacagggatacaagatgaactaacagctctgttctccagaagcttagaggaattaaaaggcatcaatgaggtaattttctggccaggtgcagtggctcatgcctgtctgtactcccagcatgttagaaggccaagggggtggatcgctttaggccaggagtttgaggccggcctgggcaacatagcaaaactccatctctaaaaaaacaaaaacaaaaacaaaaacattagccaggcatgggggcgtgtgcctgcagtcccagctactgggcaggctgaggcgggaggattgcttgaggccaggagtcggaggttgcagtgagcccagatcagaggttacagcaagccaagatcacgtcaccgcattccagcctgggtgacagaaagagaccttgtctcaaaataacagtaataatcataaataaggtagttttcagagaagaaaattataaacccacctacatcaggtttagggaaagaaggtattatttctgcttggggaatacaagatggcctctcagagaggctatgcttatgctgggccttaaaaattttacacattttaatatatgaaaataaatgaagacttatgatcacatgaaaaatatttccaattattcattcaacaatcaactaatttgaattgggtgcttacttaacatgccaggcactgttttagatgctcgggatatgacagtgaacaaaataaatagaatatatataacttcttgacttcatggagagaataaatataacttcttgacttcatggagaaaaaaaatctaaacaacacacagagacattcaaaactgtttctttcaatgatcaatttcaaggtgtttagaaattttacaaataaattgttaaacagaaagttatttacaaatatatagttttagataaagacttaaaactatgagatttcctcccacaggagaacatttttatatttacatattaagacctgtgtaccatgaaaaccagcccaggtgttcagtcagattggctggtgctgatggagataaaataggacctacctgatagtctcattttacttaaataaaataattatagaacactcagcactgtgagcacagcacatagtaatggcttttccttaattaatatcctctaaggcacatgttttatcatgtaatatctcaaatcatgatgcatgtttcaagtgtggcttaacatgccaggtgctgttttagaggcaatggtttgttagtttctattagacacagtgttattactacttaatacaaatcaatgtgagatggatcatataatcatataatttttttaaagataatattttagattattgtgcatatacaaaggtaagcatgcagaatgacatgattatgcttttacttctctttgtcactgaccagaaagatcttcatacttgaaggggtggaacatgaattgctattagggaagatgaagtggttttaagaccacttcagcagtgcccagttctggtctaagggcaggccatagtgctaagagaaaatgctgatgagacagtgattgagccataactgaaaattactgaagagttatggaagaagggccatggaaaatgtattcccaattgccaaagtcagatgaggccaatgatagattagtgaaaatttaggacacatacatgtactgttaaaattatcaagcaggtaagacgtccatgatgccgtagccaagactcaataaggcgtcataaaattaattaaacacatatacatttacatcttagcaccaaataacaacctatttgacttcaggttgactgtcccttatccaaaatgctttttgcagattgtgctttttttcatattttggaacgtttgcattacactcaccaccagttcagcatccctaacccaaaaatccaaaatcgaaatgctctgaagagcatcgtgtcgattatcaaaacatttcaaactttgcagcatttcaaatttggaattttcagattaaggatactcagcctgtacagggaaactgaggcacggagaaatttttaaaagttgcttaaggtcacacactataagtggcagagctaggattcaaactcaggcagtctggatcccacgcccatactcttaatcaaaagctagaatgtctaagataagcaggtactgttgcgttaatattattactggtagccagatttagcaaataaaaacacagaaaactagttaaattggaaagtcattcaaacaagaatttttttaagtatgttccaaataagtatgttccccagtaatatttggtacatacttatagtaaaaagtaacttgttgtttatctgaaattcaaacttaaccagcagtcctgaattttatctggcaaccctaaattggcagcctcttctaacttagattctctgatgctttgcatactcgaaaacctaattcccttaggtggatttttaaagtatcttttctaattggtaaggacctaatcaaaattgaatgaacgagcaggttgtggtggctcaagcctgtagtcctagcacttcgggagaataaggtgggtggaccccttgagctcaggagttcgaaaccagcctgggcaatctagtgagacctcatctctacaaaaaatttttttaaaattagccaagcatgttggttggtacgtgcctgtagttcctgctgaggtgggaggattgcttaagccaagcaggtcgaggttgcagtgagccatgatcatgccactgcactccagcctgggcaacagagccagaccctggctcccaaaaaagaaaacaaacaaacaattaatgaatgaagtaataatgattcttatggtaaacccaattttaaagaaacacagcactgctagaaccatcttcacttcagaagaggaagatgtttatttcatgtctacatctatccccagggaaaaacaaacaggcaaataagctccttccatggaggagggtacttgttcccttagttgtaaagggaatgtggttactgccgccttgtcctagacaaattgatcactgcacacaaagaataaagggctgccctcaggacaacagacaaaggtaccacctccccaccaatcccttggttactcaataaatatgaattcagttgcatatgagctcctaaagtgaccaacattttaaaaactgttaatttgctatataaagagatatctcattaagtcttgatttttcaccaagtagattacataaattctgattagggcctggttaaggagatattcaggaaaaaaaacaaaaacaaaaatttattttggactattctaggccaatcgtgaatcaatgactcaggtcagaatgaaatgaagagggaaatttgtacctgctccctaaatttatcagtagggttcttggggataatactatttgggaagacacctaaaaaataaagtttggtttaaaatggctgtttctggttgggtgctataatcacaacactgtgggaggacaagtgggatgattgcttgagtccaggagttcgagaccagcctgggcaatatactgagaccccatctccttaaaaaaaaaaaaaaaaaaaaaaaaaattgccaggcatggtggtcttcacatgtagtcccagctacttgggaggctgaggtgggaggatcacttaggcctgggaaggcaaggctgcagcgaactgtgatcacaccattgctctccagcttaggtgacagagcaaataaaataaaataaaaaatttaaaaaaaagtctcaaaaaataaaatggctgtttctacagaaaaactaaggagaatttaattgatttaaagaaaataaacatatcgtagttatttccggtgagagtttggaataattgtttatctaaacaattctcaccttttccaccttgctatgtctgcagagaccttagctattttccggacacctgtgctctcctgctgctttgggaactccaggtaattccaacaatgctcactcccactcctgttgcataattcaggtgtgcctctgggaaaagccgttcggatcattgtctttacccacataatccttggtggtgaaggtgtggcctaaggttaattttcaaactgcataaagatatgaagctatgataccaaaaaacagaaggaaaaaaatgccaattatttaaaagactctgggagacagaagaaacccaagatatctttaactgatgggttcccaaatgcctgcccgtggatctatcagttttcattgacctgcagcaagaatgacaaaaaaacaaacaatgcactgaatttttcataaagcttaatttattcaaaataaagaaactgtcctttattcttagattatgtccttcctacgtttttggtgtaaaaatattttcttttatgaaatgtgatggcagtacaactttcaaattttgttttttgttttgctgttctttttttttttttttttgagacggagtctcagtctgtcacccggatggagtgcagtggtgtgatattggctcattgcaagctccgcctcccaggttcacaccattctcctgcctcagcctgcggagtagctgggactacaggcacccgccaccacgcccggctaattttttacatttttagtagagacggagtttcaccttgttagccaggatgatctcgatctcctgaccttgtgatccgcccgccttggcctcccaaagtgctaggattacaggcgtgagccaccgtgcccagcctcaaatgtttgtttttaatagtcttattaggcaatgctaagagttgaacttttaaaatctttttttttttttttttttttttttgaggtggagtcttgctctgtcaccaggccggagtgcagtggtgcaatctcggctcactgcaacctccgcctcccgggttcaagcaattctcctgcctcagcctcccgagtagccgggactacaggcatgcgccactacgcccggctaatttttgtatttatagtagagacggggttttcaccatgttggccaagatggtctcaatctcctgacctcatgatccacctgcctcagcctcccaaagtgctgggattacaggcatgagccactgtgcccagccggttaaaatctatttgaatagtcagtgaatttcccaaaaccacctacgctggtcgagtggacttccttgggttcatccctgaggtggcacagggaggtgagttgacttccccagagtcacgtggagagtgggtggcctggaactcgaagctttggctccagcccggcatctgtcttgctatatagcatgctgcccctccagtgaactggatgccaagggccagacctcactcggaacaactacgctgctttgaaatctagtgggtctggcacgaaaatctggactcctaattcaaggattaaaaatgccaaacacacctgagtgtggtctttgagtaaaaacaagtttggagaaagttggaccgaatgagcacagagtgctttgcgcaggaactcttttcgtcggccaagtggtcagaagtgctctctccctatgcacaatagacaacactgtaatgttttcctcatagatcttacaatgtaattgtaaaaagtgtggcaacattgatgacaaacagatggcaaattaaaccttgtcataggacaaataactcaaaaatagggagttttattggtaaacgatgtcagcattttctaagtggatttttttttcctaatgtagaagaaatgtgcattcagcctgaatgcattaacaatcgatcgccccaaatgctgactttcaacacaagacaatgtgcaggaattagatatagaagggataaagtgagcaattttataactcaatgtgaaatcaagtctcttctcgtcttaacaattaaacataggagaggaaaaaacccaactcttacttacagtaatgccattctattataatattcccttaacattgaagtgttaaaggatgcttttaccacttagcagaggaagacttgcagcagagcccctgtattatttcacaaacatccatcaagctccctcaaagctgaaagctactctgtgctaatgatagaaagcacatttatgctgggcttcccatatattcagtgggtagagatttctaaaacataaagtcattagtggtcaagtaactcatttccttggtagaacacacgattagtcagtcatcgattcaaaggcattaattcaaaggcgcataaacagccctctctgtgtgagtcatttaaaaattctgttgtctgaatttaaaaagcaagtcttaacagtcaacaaattgtcaatgaatacttaatacaatgcaccatgccaaaaattatgcagaaaaccaagaaatacatgaggcaggatgatgccatttttgttaaaattaacaagaaagcacacatatatgcatggccatatgtggttaaactgaaagctctacaccaagagattaataagaactaacctttggtgatgggttctgggtgactttggtatttttttttttttttttttttgcttcactgcatggtatgagccatgttaaatgaacctacattgctctaaagggtttttatatgctgctttttgaagaagatatataagacatagtccctgcttctggtgttttgggagtaaacaatcgtgattgggaggagtgaggccgcctggagttatgaaggactgactacggacatcatttgtttgtttttatactcagcttaccaaaaaaccgtatttccatctttataatgcagtaagtccagcccacattccaagaacatttcaaaatataatttgtacaactactacattcagcggaaatgaagacttctatgggcttgtcaatactccatttataacggtttctgtggcaaaatgcattttaatttccaataaacaagtttacagtggaatttttggaaaataactcggaaatatgggaagcacttacacacctgcatggtaataatgactcatacttactgtttacttgctgcattctttatttggtttcaccctacaacagccttatgtgggagattttattattactcccattttacaggtacggaaagcaaggcacagaggtcacaaaacgtttcggtcaccaaatctatgcagagcaaggtttgaagccagacagtccagatccacatcctgccacccagctccttctaatcaattaactgccagttttcatgtgctgtgggtgctgcacgtaaaagtgattaacattttttgacggtgttaagtccggataaagtaagcatatttcagtattttgaccaaataaaataaaaacctgcaactgaacataactgtttttgtacaattcaattaaatgaagctgctgggcgcagtggctcacgcctgtaatcccagcactttgggaggctgaggtggacagatcatgaggtgaagagattgagaccatcccggccaacatggtgaatgaaaccccacctctactaaaaatacaaaaattagctgggcgtggtggtgcacacctgtagtcccagctactcgggaggctgaggaaggagtgaatctgggaggcgaaggttgcagtgagccaagatttcgccaactgcacttcagcctggcgagagagcaagactccatctcaaaaaaaaaaaaggaagccctgcacaggtatctggagcagaagtcagcaaatttttttctgcaaagggccagaaagtaaatatttgagactttgcagagagtctgttacaactacttagctctgccaccatagtgtgaaaacaaccctaaacaataactaaacaaatgagcatggctgtgttccaacaaaactgctgtccaaaaaatggtggtaagtaagattttgtctgtcagccataggtcaccaccctgatccagaagttatataagtaaataataacgtaatgtatatttcaaaattgtggagtatagattttaaatgtttgcaccacacacaataagtatgtgaagtgatggatatgttaattagcttgattttattattccaaaatgtatatacatattaaaacatcacattgccaggcgcagtggctcatacgtgtagtcctagcactttggaaggccgaggcaggtgggttgcttgagctcaagagtttgagaccagcctgggcaacatggtgaaaccctacctctacaaaaaatcagccaggcatcgtggtgtctgcctgtagtccagctacttgggaggctgaggtgggaagatcacctgagccggggaggcggaggttgcagtgagctgggatcgtgccactgcactccagcctgggtgacagagggagaccctgtcttaaaaaaaaaaaaaaaaagaaaagaaaaaagaaaaaaaaatcacattatatcccacaactatatacaattactatttgtcatttaaaaatacaataaattcactttttttttttggagacagagtcttgctctgtcacccaggctgaagtgcagtggtgcgattttggcttgctgcaatctctgcctcccaaacttaagcaattctcctgcctcaacctcccaagttacaagttatgccttgtaactgggattacaaggcatatgccaccataccccgctaattttgcatttttagtagaggtagggtttcaccatgttggccagcctggtctcaaactcctgacctcaagtgatccacccgcctctgcctcccaaagtgctataaaaagaaaataaatgttttaaatgatgcaattataatgtagccaataaatccaactatatctgttaatccttgaaaacagaggttcagaggtttaactacagatattggtaaaattcccttatagtaaataagaaacagcagagtactggtcagaatggtccaaatgccttggaataatgctgttaattatttaacagtattgtttgttaaatacctgataagttgaacccgaccccccacgacttaccagtgatgggataggcagccgctgcaaaagttattactgcaaaggttcccgtgcttttagctaatagtcaaaaaaccagtttaagtaatcataataagccactgatgtgaaaactattcttccccaagctttttgggtaaaaatctaagatgtatattacatcagaagcaaagactccactttttaataagtcatccatgataccatactttcagaaggcactattggcatcaaagttaaactttttggtactattatatagatttgacacagagttttgcatgtccatgactaactctcacaatagttccaccaggatatctttacatagttgcatcaaacaaaattcctatagaacttaagcaaatatcacagttccctgttgataatgaagtcaacccatatttgaatcaaatttccattctgcattttttaaagccccataaaaaatggcatccggcaagctaaaattgaaacataaagaacaactgaagaacgtcaagcattttcaatagtccatcttcacttctcacatttcctttagtaaacattaaaatgcagaaaaactggcaacatttttaagtcttttaagtgcagactcaaatgtctctgctttgcagtcaggatgcattattgatagaactctttgcaaaccaggacttcctctaggaagagcagaggtttcagataccacgtgcatgactagagcatgtcaaagggacgatattatagattaaagtagatgaatactggctgcatctttactttgtgaaatgccaggagaataaccgggcatcatctttgccctttgcacagcctgaaccaagtgatataaacatacaaaacctcattctgaaacggtgaaaacaatgtgagcacacagcatctgttcggactttcagatagctcttctcaagccaggaataaagccacaagttcagtttttatttttattttttataatagagatggggtctccctgtgttgccaggatggtctggaactcctgccttagccttccaaagtgctgggattacacacgtgagccactgcacccagcataaagccacaatttaactgtggacactgtaatatcacttagaaatgtccaaagcagccaataaaggatacaaaaatgtagtcatccatgtatctcttcttcagattctccacgatggagttctctgtgatcttggacagtagcaccatgtcgtccacaccactgtgcttgacattgtggctttgccagtggtactggtagacacctttgcttccctgggaacataaaacatacaattactaggatagtttgttttcccctgtagtaacaaagacaaaatgctgttaatttcccaaatattcttaaaataaaatgtagcagaaagagcagtgcagagaaagattctgcaatcaataagatgaggattcaagttccagctttgctacctacagactaagttaagtggggaaaagctacctaagctcatgtgtccctgaagtgacacaaagtgacttctcttttctcatttgtaaaatgggagacagacccatttcacaacgctgctgtaaggattaaataaaataatatgtgtgaagtgctaaacagtgtcaggaatacagcacaacacacggttgacagtctcggatgagactatccttcaaccatactgttgtgttgaatttgtcggtgaaaataagcaacgacatagaaactttctagtcttgttttgcaaactacatgacagaatccagaaatggaaagaatatgtatcacacaaaggctatgtcacacggtcataatttctcaagtcatctaaattactttcccttcataaacttatcactgtcatacgtgtaatactggctttccatattcaaaagataggctacatttttatgactgatcactgctccaataacgaggatgtggacaggacagacgaaacgagatcacggaacatgcccaggaggggaaggcctcatccccgcatggcccccttgggtagatgaagctgtggccctcatctacgtctgggatttttcagcttcacaccaggggcggcctctgaacactctgtgggctgcagggcttcctttcatttggcatttctgtagtggggtcccccatgtgttcagctacgtgacaagttcttatggcacacttggggagcttaaagtcctatgaagacacctagataatgatggaacaaagtgactcatgagcacttggggagctgagcacttgggcagttcaaagtcccttgaaggacacctagataatgatggaataaagtgattcatgcgtcaataacagtcaacataaacacacacaaaatgggtgttccaggagtggaggttaggccactttgtcctgggagaggcagaagaaatgacttcccagaaaaggagccatttgaagtaggtctaagatatttagaatttgccggaggagaccagaggaggaaggacattcattataatctatgccggaggagaccagaggaggaaggacattcattataatctacacttatcagcaaaaaagctaataaatatgaagtaatggcaaatattacatgacaatattggaagatcctcccttaccttcaaatgcttgcattctactgggagtgtcgccagtgggtaagtgcagtgggcactgcactgggtgagactcgcccctgccccctccctgctcactgctcgggggacttcgaatgaagaagagaaaaattctaaataagggtatctagaaaggccaactgctcagacatcaaaactaggatgaaaaaagggaaaaggaggctttttgagaggagaagatgacaagaaacaagatggaagccattccaaattttattttaaaaatttattaaatggtttacttttttttcgatgggaaacacagatcctttgctaagagcaagttctaagaagctctgggaaaagccatcttttaaaatcagccaagaaggagctaccacaggaaaagtgtacagtgtcatgggctcctgctctggaaagggattctggaaggcctgccacccatgctgtcttgcagaaggaaactctctatatctggcattctcagaaccacatacagcatcaattctacaaaattacctcagacctcaccactccttcttcctcttgtggcaaagcagaaagagaaaaaagcactggccacagcatgactcactagatttccattgaatgcccatggtctacttccagccagataattcccagtgattcctcctctcctcacctccccaccttttccagctttctgggcacccacggttactctgcacagaaaactagggtcccagagtaaccaacctgcagattggttggttggtttttaacccccatagacatctaaaaatggaagcagagttgaataaaacacaagggctgttaataagtacttattcaacttctataaaggacaagaaacagagaagctctgtgtcatggtgcgtatgtttgtattgatccgaagaaactgccttcctagcgtaacccaagtttgtctcagtatcaaacccattggtctttctctgtctcactgcacagagacacattcctgactgccccacctcagaggctgtttcctcctttttctcatggtagttatttcctagcagaaaagcactcacggtagagttcattgattctcatagttccaagtatcactcgatactgaagattcctagccccagtctctaatgctcaaagaggactcattttccagtctgctgtctatataacaaggtgacagtggttacaatatgcaaaggaattagttatttgatttgtggagggtgttctacttactactgcaagcaatcctaggagagaggggttaacattcccatgccatataggaggaaactgagatctcccgactagtaagtagcaaaagccaagatgtgaaccgaagattcgatgactatggacgcatccaaacgtggtttcttcacagtctcatacatgaatgactgacttattggatatttctacccgttaagtttaacatgacaatggaatgacagactgtctccaaaaccaaatgtatcattaaaaagacatacaatttttattcatgaccacctcctcttagcattagagactaaaacaccaaagttatttttgatttgatacgttttttatatccaataggtcacatatcagtttctgtatctctctctccctctccctctctctcttccgccctccctccctgtctcccttccctgtctctccctccctctgccaggcaattatagttacatatgtgaactcattcaaccttcacaaccatccccccatactatgtattactatctctattttactgctgaaaaaactgtaaactgcccaaggttttctaatggtaacttctgtctttagtgaccactcctcactatgcatttattctccccactcccctaaaaacccacccagatgaggcaaagggagagagtaaagaacctggaggtgggagcaactcagagcctttgggagaacctgacctgcccagatcgtcaaggacaaggtggatcaatgaaagctgggaagctttagcagagggtgatatggttatcagcaaagctggaaaccaaacatggatgtgcagaccctcagcccagccagggaagctgaaaagttccccacagtgaaacaaaaaccattttctgttgctgggtaggggacaacagaatttgctactagtgtgacttgtccagaggcacacagcctctgcacacagccgctgaatgccaggagttacatgggcggtgtggtggggcattgttaccacgcactatcctacgctctagggagcagaggctgaaagttgttctaagacacaaactaccgccctagaattgtgagaatatgcaatagggctctggggcaactaacccttcgcacccgttttgcccctcatttcttcctctacccctgctgagaggcaggggcaggtttggctgccatgtgtgctgggagaggggcagcagagatggttcctcatcagtgtgagggcagccattctcttcagagggcaaaggcattgtttattgggctactacttcatgactctcaggcgagcttcatttttgagtaattcccttttgctccccccactaaaaatggtaccattttaaacaggtggatactcagcaaggtattgcattttacagcagctcctggtgagcgcagcacactgtacaaagggaggagggcagtggcgggcgtgccagctacgacatgaacgtaataataacaataatgaaaagttactcttatccctgacacttcctacaaattatgacggagaaatttccattagatagagattgagtgcagacactctcagatccacattccgtttctaaggatgacgtagtttattaaaaagcagttgattcatgtgcaagttctggaaagtagggtacgcccctatccacataatagcctggtttgttgctaacatttaagaggtggaacccaaacaccagagtccctcacacacaggaagaactcggccttgaggctgggaacctcagatgggtgattccctgactgattttttcaaaggtggaacctcactgactggtgtctgtttaccagggtggggaccaggaagagcaaaggtgagtcagcatacacaggaaggattattctctcctgaaagtccaccttcattgcccaggagacagccccagggtaggcctggccccacgcggcagcggttctgcaaacacttcattagtgtcccagggagcactgttctttgatgcatctgggagaaaggaggagttacccatatacttggtaaccactatcttcaaatgccttcaaatgcccagaaaagggagacaattaagtgtgttgtgtaaatacaacaaggtcccccaccccgtacagggcagtggggaggaggtgaccatcaatactcttacaaacttctacaaagagtaaactgcacagtatttttaggtagcaatttagaaatcggtattgaaattttagacacacagaccaatatataaacatagttaactaaataaaaatcaaagtctgggccaggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaaaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattactgaatttgtgtaatttttttaaaacggcatgtttgctataattgttttgttggtacttttggggagaagacctggagttttaggagaaatgtaacctttattttccattttagacctttctgtacagtttacattttttaatcatatgcatgtgttagtaaaatcttaaaataaatagaaacatcaatataattgagcattttctgggttgctgttgggcactgaccaggctctcaaagtcaaaagccaggactgtcctaagactggattctatgctaagtccaggtttgaaaggtgattggaagacgctgtgtggacagtaagatagtatcatgtctgagccatttagttggcccatgagcacaacaggacagcagatttgatttcagaaaacctgggactagaatgcccccagtgttataagtagatcaccctgagaagcagataaaccatattcttacggtgaacaatggacaatgggtaacactctggcctgcagtcaaactgagcttgttttgtaatgggatttttctgtctccgtgagtaataacaggaaagggactacctattttaattttaagacattctggaattccaccttttacatttctgccattttactggactgaaacatttacttccactgcaaatgatgaaaaatcaaccaaaaatatttgtctgtctgctacatacaaggcactgggcttgcaaactggtctacaaaccagcattgggcttgcactttatttcaactttatgaaatttaaacccctaatattttggtgatgggaagatgtgtctctgaagcaagtatgtgtgtgctggacttcagtgcacagagtacaatatgaggaaaaagtgttcctgaaacagtgcatgggggacagggtagtcagtagccaacaacccactctcaaccccttacactcctagataattggaacatttactgaaaccagaaatacgtgccaatgctttttacataattatctcatttaattctcacaacacttgcaagacacaagtattataatttctgcactattttacaaatggagaaactgaagcttggggtcataatgtaccatgttgcctctgcttggagtgggtggaaaagtgcactgagggggtggcacgtgaggctcggggaagggaatactcaatgaatatggagtatgtgcttattcataaagtttcatccatttaaatatatgtgaccataccacagattcattatttgtgtagcattttcacatacacgtggtctcctttcatccctgagacctgacacagggatttctgacttccttttctctgctctttctgcgataccaaagctcacttccaatatcatcgttaagtccaagtgtagacacaggctccaggtctactgtgggtccagtgatctcttagtcagtggtgcctggaatcaaccttcctagaagagctggcccccggtggagaagtgttccaccactagagcaaacatataatgtatcattcagcccgggacacttttgatgcagaagagagtgttgttaatgataaagctggaggaaggcacataaactgggactgtctcaggctgctaggttgcatctgtgaccaacttgatctcaaaaaagccaaggacaactctcaaagactagccctcccagccaagaccctgtgccacttagccatagggtgtcacacaaatcagtcaacctcttggagcctgtcccctcctcagcaaaaaggggttcataacactacactcccccctgggccactgggaagatcaaataagactgaccatcaaaccacccccaatccttttaggggtagagctggttttacatgatgacatgatccagtgcatggaaggtgcacaccaagccagcaacattggctgagtgggttagaagggggagggaaaaaaaggtttgttgaaaataacaagggatggtaaggagccccaattttgttttgattgaacgtatgatagtatttatatgcactatctctgtacaaaaatacagttgttaaaatgttgtggttgtttatctcagtgtactttctgcactgttttatttttctgagtatgtatatataaaatatacacacacagagctgttttcattgtgaaaaaagttagatcaaataagataatggatgtgaaagtcttgctaagcagaatgaaatatataaatgtctgacactgttttccatattttttattatttcatgtcaactcagtctccaattctttttgtttattccagcttgcagatatagcaaactttttttaacaataggctcccagaaagaagagacacgacagctttcttttactttctctgcctgaaatgtcaatctcaaaaggatcattttctatatcaatgaacagttcaaagataagatgttgtaaatgaacagttaatgtattccatcaactctaagatgcattctttttcacattttcacattttgaaattaggatgtcttataatcaactggacgcagcagctcatgcctgtaatcccagcactttgggaagccaaggtgggcagatcacttgaggtcaggagttcaagaccagcctggtcaacattgtgaaaccccgtccctgctaaaaatacaaaattagcctcgtggtggtgcactcctgtaatcccagctactccagaggctgagtcaggagaattgcttaaacctgggaggcagaggttgcagtgagctgagatcgcgccattgcactccagcctgggcaacaagagcgaaagtccatctcaaaaaaaaaaaaaaaaggatgtcttataatcaatgatgtgttatagcttaactggcagtttttttttatttttcaatactgtaaataaaataatgatgctccttttataaccagtagcatcttaggtgtgatatattctggcgcatgacatttactaagggccaggtactcttcaaatatcactgtttaatatcatcacagatgaaaaaatattataaaaattttgattactctggaagcattgtaccaaatactaatctcacgtcaggaactgtgtagtggctttactggtgaggctgatgatcacccagttttagaggctttgttgcagaaatttttgtagctgccaccccctcccccatcctcacctccaacccactagaggatgaggacaagggtcctggatgacaagctgcccaagagaagccacccatcaccagaccacagctcgcaaagcaaggtctttacgtaatttcctcttcgctttgtaaagacatgttcaagtttgtatctctttcagcctacaggttctttcaatattaacaccatttgaagcagaaaggtgtcccaccctccatgcgatatgtctgccctgggattactatgatgtctgactttccccatgacttttccttttcttttctttttcttttctttctttttttttttctgagaaagagtcttgctctgtcacctaggctggagtgtaatggcatgatcttggctcactgcaacctccacctccctggttcaagtgattctcctgcctcagtctcccgaatagctgggactacaggcgtgcactaccacaccaagcttatttttgtatttttagtagagacgggttttcactatgttgcccaggctggtctcaaactcctgacctcaggtgatctgcccgcctcggcctccgagagggttaggattacaggcgtgagccaccgcgcccggcccccatgacttttctgacatacaccacaccatattgcaatctttcctaaacctcagtcattttcaactattttaacaagtttcctataaccacattccacagcacttgcttcaaatttttctataaatggtccttaataattttgattaaacctacacaacaatcttcataaaatccaccagtttggtgtgctagttttgtttcttcaacatgtaaaaatagctacgaagacaaatgttgtaagccggtcgcggtggctcatgcctgtaatcccagggctttgggaagcaaaggtgaaaggattgcttgagcccaggagttcaaggctgcagtaagctatgattgcaccactgcactccagcctggtgacaaagcaagaccctgttcaaaaaaaaaaaaggaaaagaaaaagagaaatattgtaaaatacaccagtgtggggttgtacataccgatgttaaggtctaccctggtgccatgttccacacctggggacacactggcattccctattgggccttttcttgtcaatttcaagtccagccatagggaatttaaataacttctgttcgatttcccaaatgcattttactctgctgtggaaaatctcacatggtaagaccagatttcccttttagtttgcaggcgagagtctaggttgtgttctcacaagtagaacctaccctatgtttgtgttctgaattccctgcactttccatcagggctcccaagccccctgctctgtctagacctcccacctcagaaaaccctcccagccacaggtgggacatgtcagtagtccccagggtcagggcttgtcttgaggctgagcaggaaattctcttgggtaactgctttttattctttctctctcaggaagtgcttcccgtaagcattaccaaaacggttctgtcctctttccctcacaaactccaggaaccctagaatggtggctcctatctctgatcctcaccaaaagtccctttgaagaccaggtgtggtggctcatgcctataatcccagcactttgggaggccaaggagggaggactgcttgagcccgggagttagaggccagcctggacaacatagcgagaccccatctctacacaaaatcaaaacattagctggacgtggtggcacatgcctgtggtccaggctactctcgagagccggaggcaggaggatcgcttaagctcaggaggtcaaggctgcagtgagccgtgactgcgttactgcactacagcctgcgtaacagagcaagacaaagaaagagaagggaaggaaagggaagggggagtgggagagggaggggaggggggagggggggaggggggagggggagggggagggggagggggagggggagggggaggggggagaggggaggggaaaggggaaaggggaaaggggaaaggggaaagggaaaggcctgggcagcccaggctctctgagatgctcagggcatccatcctccagggcacaaaaagggctctggttgccctcatcccagggagacgggcggtcagaggacagtggctgccttcacaagcctggtctggaacccctcaaggtagctgcgcatgcatttgaagtgcaaatcttagcgaggcttccctgacctgtccttgtccatctctaacccctgctttctccgttttgaggttcccaccacaccattttctgtgcataccatgctgtgctttgtttctgtttttccacagtgtgtgtgtgaggtgggatcttcagtacctacattcccactgtcccccagcttagggtattcttctatgaactcctccctacctcaacccaactctatgcctactaaactctcacccagcacaggtcaggcatcatcttgctaagaagcctgctctaacagcattacctgagtgcctggctccctgattaaactgacccctaggaccaagtcttattcaccattctgccccaagacctagtagagtgccatgatgcatggcatgggcagcccccaagtatttgttgaatgaatgaaatacattattattattctcacgtaacagctaattcttattacataccaagcactgctctaagcattttacatataacttatctaatccttacaacttcacgaggcaggaaactgagtgaagcacagagaagttaagtaacttgctcagctcccacagctgggcttcaaacccaggcagtctgcttcagatctttgcccttaaacattgtacctactgcctctcataataaagtaacagcagttggaaacagcaataattctaaagttcatagtaactgctttattgcatgtttactatgtgtcacgtatcaacttctttcatctgcccaatgacaccaccaagtacttgtattatccttttttttacagaagaaaaagaagtaccacgtggtaaacagaatacctggtacaaagccctgcaagctaggagctcacggagcagcctggctctgcacagccttgcataatgcagaggaagttccgtgccctggagtcagccttgggatgatgtctgccccctgccatgtccccaccagggtggtgcctggggcatgggagtgcccaatctttactagctgggtgaataaattccaggctacactgactcacctcacaacatgtttgctgtaggtacacggcagcactgtggcagcagctatcgtggggcaaataggagtcctgggcccagagtctgctccaaggaagaaataagtttccaaggcgttcctatttgcccccaactcaggagatcaaagggaagagatattgcccctaaacacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctaccaaaaaaaaaaaaaattttttttttttttgtagagacagggtcccactgtgttgcccaggctagtctcaaactcttgggcttgagcaatcctcctgcctcagcctcccaaagtgctgggattataggtgtaagccaccgtgcccagcctggatgattaactttttaaacagaataacaggcaattaatcttcaccacatcattagtgaggtaaggacatttcaagctacagaataatatgaatcaaatgcttgagattccttaatatgacaaatgctcatttcacttctgctctgattatattttaatcaaacaagtgacaagagagtcacactgatgttagtccctgtcttttcagctgtggctctgctagcatgtcacatacatcaagcacttaacagtcccttaagagagctcccacatcaccactcttgtttttaagtgcaaagctcttagacattcggtaatacgattcaggaatgtaacttttcttcctaatctagcaaactgattaaaatcaacagacttgggtacaagctctacctctcacatgcctctgtgccttgggcaaggccagtttcacagaattttattatttacagttttaaagcaatcttgcaaggtgtggcggttcatgtccttcatctcagtggaggctgagacagaaagatcacgtaaggccaggagtttgagaacagcctgggcaacacgcaagacactgtctctttttttttttttttttttttttttgagacggagtctggctctgtcgcccaggctggagtgcagtggcacaatcttggctcactataacctctgccccccggcttcacgccattctcctgcctcagccccccgagtggctgggcttacagaaggtgcccaccgccacgcccagctaattcttttttgtgtgtgtttttagtagagaactcctgatcttgaactcctgacgtcaagtgatccacccaccttggcctcctcaagtgctgggattacaggcgtgagccaccacgcccgactagacactgtctttaaaaaaaataataaaatcaattaattaattagctgaaatgaattttaaaaataaaagtgaaaaaaatttttaagaaaaagaaaagaaaaaattaagtcagcctattaaatgcataccaaattagtgtgtgcatgtccattaagatttttattaatcatacaggtcggcacaaaagtaattgcggtttttgccattaatggcaccggcctaatagattcataagtcaaaaatcctaccagactctgtgtcctaatttgtggtttgaaaatgatagtctctgaagtagtagctgctcaatacctttttctaattcaattacacagccaaggtaatgaggcaggaagactagctagaaacaccagcagctgtgcatataaataaagacagggaggtaactgaacaatttcttgtgacataatatgaactatcaccctgtaccatggaacaaagaaactctaatttaaatgctattctgagaaaaagaacagtatgcaaagagttatcagcaggctgtggcagagttgatatcaacctgccaaaaagtcaggacttcctatccttggaagaatctctcctatactgcttgcaaaatacgcattatttataagtcatgcaaaatgctggaggtatgctgacatgagttaaccaactactcacatgttatggttttctcagattgccctatttttctgaaaaatgtttggggcatatctgaataagaactcaatttttaaaagttttataaggttgatgaaattattttctcatctctgtcttttaaaagccaacgtggaaactccacaagagtataaagagttggattttaaggagcggtgacacaggtaaggtgttggtgtgtcatctctcacttaggggtactgtgtctggacgtgctaagcgggggaagggtctggatgtgatcaggggtgtcttgatgtgggcacagcctttgttgtgggtttgctatagggatacggagtccagggaaacaagccaagctcaggggcaaggagcattccctgaacaaccactagccaacgctgaaccaaatgcagaagtgaggaatgcctgtttctggcatggttacttctggacccttggcttgcctgatctgctctgatctatggcacagtggcaccatgtccctcttggggcaaaatgtaaccataagggcattggtctaggggcctttagggtatcaatgacacatgtttacaaacagagatctcagaccacagctggttgatgggtggcagagatgagagtcccgtgggcacatctcagggagaagccacaagagcagccactaatccacatggcagatcagtgtcgccaagggtcctgcaggctcagggccgctcaatgtgtgatcacaaacaagttcatcctctcactcccttccaccacctgacagaggatgcagggctatcttgctgtttcttctgatccataccttggactttaggagtgggcttggggaacttagaaggggtggggaaaattaagaacaagcttgataattcaactaaaagccctaggatagacatgaagggaggcactgtcttctaatgggcctgctaggggcttgtctctcggaacccacacccaaatcgcaagcccagtttgcagaaggcaagcactgcagcatgcagagacgggagccttatcttctattgatgtgtccttcccgacagactttctgagggctacctgcagttgctgccacctccccagccccaagttcaatcagcaagctctagaatgaatttgcaataaaaaccaatttggaagatcagcacggcttcactgatcttaccaggaccctcactgttgtatgcttctagggtggccacaaataggtagattctgccttcctttgatcagcttagatctttattaaaggttcaacagcaagccaatagagcaggtcctcggatgacgccattttgtgataaagataatgaggaagaaaaatggattcctggtccagccagtgaggagtctgcatgtttttcccatgtctgtgagggtttcctcccacatgccaaagacatgcacattgagtacattggggtgttgacatggtctcagtctgagtgaatgtgggggattgtgtgagcaccctaagataggatggcctcctgtccaggcctggttcctgccatgctccctgagctgccgggatagactctggccacctgcaaccctcaactagaaggagtggatcagaaaatgcgtgaatgaatgattataagttattgtcaaatgaaaacttttaaagtagatgatagtcatacaaatacatgacaatcaacaatgtgcagcgaaggcgctcagcgagcctgccatgttcctgatgggttttgaactgcgtggtgcacagaggcactccttacagttctcactttgcaaacaattattccttaactcaaaccccactactactaccactgtcactcaccgactcaccaaatattgggcaaataattctattactttttttaaattaatctttcttttcttttcttttttgagacagggtctcactctgtcacccaggctagagtgcagtggtgtgatcacagctcactgcagcctgggcctcctgggctcaagtgattcttctgcctcggcctaccgagtagctgggactacaggtgtgtgccaccatgtctggctaatttctttagtttttgtagggatgggggtctcactatgttgcccaggatggtctcgaactcctgggttcaagcgatcttcctgccttggcctcccaaagtgttgggattacaggtgtgagctgtcatacccagccccgttcagtgcttttgagtacattaaaagagataacgcacagagatttcatattacccaagctcacagtaccagatgagtaaagttttgcattggttattaataagtgaactgggatactactagccactaatatagctctgattggatgtatgatatttcaagaaagagactgggtactgtcatctcatctggctaataagataataggagggacaggattcaaataaaaaatatagaacttttaaagtttcatgatgctcaagtgatgtataactggacactataaatgtgagtcaatttgaatatgggattctgagaatagggatccgccacagaaaagaagacgacagacagtagctgcagagaagatacatagggagttcagcaggctaaccaaaatggaagccagtgacaaagaccatttgagcaacagactgatgccttgtaggcaaaaaattaaggtgtttaaacaaacaacaaagtggcagggataaggaaggggcagaatacttacatatttacattcagaaccctaaaatattgtagctggaaggggcctggcctatcgattaagcagtgcaaaacttttactttacagatgagggacctgagggccagagaggtgaaaggatgtgtccacggggccatcctggactggaaccaggactagaactcgggtcctctgactcccagcccagcactgtgcagctctctgcttccagtccctcctgagcaaatctgtaccaaaagttttttgtttctgggaagaaaaataaggcactattttggatgcttaccataaaataatcagctgaatccaggcatttatataatttgaatttctcaaataataagtaataccatttgtgagccctgaccctctggcaatcaaactgcatgaggagactggggtccatccaaatattatatatgggagcagctcaatttcatcttagtttttaatgtaaagataaatacaaattaggttttaatattttctttccagtgagtttccttgcacataaaagtgcatagaccccactttggagatctctttcccagaaccccttgtcatccacccaagacacaggtgtctgcttatgggaagaaagtaagagttaaggcattggcttgaaatctagaaacaagacagacagaaaggaaaaaggcaatctccagaagatgaggggcaatgccagcagaaattagaaagctgtcatctagttagagatctctggctgtagcatttcaaggtgttccttctgccagtaactctctcctgccagaatcactaaaactgaaagcaaaacacaaactgaccatgtctgatgtgattatggacatggttgggtcacaccagtttaaaactcacaactccctagaaaatccaaggaaatttttgcatttccttctccaagaatacttacttctcattgtatctgtgaaatataatatggcatcaaaagggcaacccacatcaagaagtgtgccccacaatgtttggggatcggggaacgggcatcacttttcttgagcaccaaccatgttcccaatgctacgttaggtgctttgcgtacattgtttcatttggtttcaaaagaattctagaaacagggaggtactgtgatccccatttaacagatgaaaaacttggtgacagagtgtgtgtgtccatggaatccagatttgtactggtttggtggctttagaaacctggcagcttctattaaggctacggtagaagacagaagaaatggattccccactcggtgaaaatatctcacgggagatgtcctctgagagccaggtttcatatgcaacccttgaagctgcctttagatcccacagtggtaaactggatgaagtgttaccttggctacggaacagagctaccctttctaaacagagggacattttgggtaccttgaatgactgactcttagaaagatcacgggcacaggagatgcctcagcaaagctgagatcagagctttggagccaccctgcgacatctttgggcctctgccttgtctccttgaaagcatgcctcgtagccagcttcaaagtcagactccccatgcctggtgttcagtaacagcgggcttctcattcaaaaattttgcagaggtaatagactgtgactttcttttgtgacaacggtgcctcagcacaatcagacaacttgaatatgtttaaaataaccttgcagaaatcctcagaaaaagtaggcaagatagacatcaattgccaaaacagtcccagctagggatccactggaggaatttttaacatagtttccaaagtcaaacagcatgccactctcaaccctgcaaagtcagagctggtagtaaatgctgggttcccttgctgtactgacaggaatgagagtcaaaggtgctgagataaacacacaaattatctcaaagcagtaatagtaaaaatcattttatgcaaggaatggagaccaactgatacccactctccgcattaggtagaaaagagtgtgctcacacaattaaagtacaagacggcatgctcgatttggggcaggacagtgaatagaaaacagaagtcaacatcaccacctcaaacagagcgttgtgctcacaaactgccagcaagaccacaagcatatctgcaaaaacatttgcatggtttctggttgcaaaaatgctgaaaggatttgtacgatactctgttcccaagtgcacaaaagtctctttctacctgagcccagcgacccaaaatatgaagaaaagcagcaccagtactcctgatattctttgctggtctgtgaccccttcctttccttggagttggaccaaaaacacagtattacctcctaatcaaataaccaacacccaaagatacctgggtgtgactacatgtcaattcaagttcaccggagttaaaaggaaaaggtttcaccgattgtttgttggtgtttgttggaggctggtgtgtttaagatacagaagtagctgctagctttgcactaaaacaaacaaacaaaagcacatttcaattattttttatttattttttaaatttagtgcagcaaaaagagaacaaaggtggccaggcgtggtggctcacacctgtaatcccagcactttgggaggtcaaggcgtgcggatcacctgagatcaggagtttgagattagcctggccaacatggtgaaatcccgtctctactaaaaatactaaaaaaaaaaaaaaaaaaaaaaaaaaaaaagagagagagagagagaaaacaaagattaacaaaaagagaaatagcttgagatgccgaggaagataaaaagcaaatgatttaaattaaacatgagggaaacattaaagaagggaaggaaataaaacaaccctagggatctaaatagacaacaaagaaaagttgtttgatcacagggcaagcagtatgaataaatcaaataccataaatgctctaaaggaaaaaaaaattttaaaaagtttccttccaactctcattctaaggaaaccacagctcttttgcttagtataactatagttcacatgctaaatagctaaattcagctttttaaaatctacccaacactctctagatttaaaaatgtaagtaaaccgttcagatcctattgttaagtaaattttgtttggtgagtggatttgttttgagtggctgtggataaaggcaaggggtgattttattttactggtcatttaaagattacattctttttaaagaaaaaaatctatgatagttttacaggatttcaaggcaaattcatcagttttgtttcaaacacacccaatgggtgtttcccttgtctccaaatgaaaagccttaatccaccttttcctacatgtgtttctacagcatcttctggctgtgagtttgtacaccactacagaattattattactatttcaactcccatgaaatgtactacgactggcaggcatatgagttctgaaatttaaagtgcgttactagagaaactaaaactcatgttggccgcaaggatggacaacaatacgaaatgctacagatggcaatgggaggcctaaaacaatgtgcagttcctttctattctggtttgccccattgtgttctgaatagactgaatcactgcccagcttcagggccagcctctgaaaggccccattgtaagggctatgctttccagagcagagttaaggttgctgtagtaaccttcactatgaatttcctgaccagtgtgatgaaaatctcaactgaactgcgacagtactacagctacaaacaagaccgcgaaatgagcgtgggtctacccatttagggggtctttcttatctgaacatagcccactatctactacttcaggcatccacattgccaaagaagggactaaatttctacaagccagagcttgagaggtgaccttgttgtataaagtctcagggggatctatcccataggatttgaggtggcaggcaaatgggagtttgtagacaaaggggaggcctcggctcataaactgtttaagctgtcctgtgtgctgggctggggaagccacttttctggagttgcacagggaggcatgggggtaccattggtccaaacaccacaggtaaggaataagtctgcactgagtgggagaaaacagtttagaattcagcaaggcaccctttttattctgctaggaaaagaagggcaacggacaatcacccccatctaccagatggaaggcacactggcttagaatgaaaccccctcccagttaagtttattgagggttccctatctgccaagcaacattctaagcactttacttatactaactcattcaattgtcccaacagtccataatgctggcatgattattaacttgaggtcaggagtttgagaccagcctggccaacatggtgaaaccccatctctactaaaaatacaaaaattagccaggcgtggtggcaggcacctgtaatcccagctacttgggagaccaaggcaggagaatcgcttgaacctgggaggtggaggttgcagtgagccaagatcacaccactgcactccagcctgggtgacagagtgagactccctctaaaaaaaaaaacaaaataaaataaataatttttgtgaaattaaaaaatatgtataaagctaatgaaattcagctgaatctaaaatattaagcccctaacatatgtacagtgttgttttaggcatcacagtgaattcagaaaaggtaaatgaagccctcaaaagttttttcatctgatgtagcaaaaacaaaacaaaacaaaaaaccctgatatatgggccagctgtggtggctcacgcctgtaatcccagcactttgagaggttgaagtgggtggatcacttgagcctaggagtttgagactagcctgggaaacatggtgaaaccctgtctctactaaaaatgcaaaagttagccaggcatggtggcgcatgcctgtggtccctgctacttgggaagctgaggtggagaaatgcttgagcctgagaagtcaaagctgcagtgagccatgattgtaccactgcattccagcctgggcaacagagcaagaccctgtctcaaacaaaacaaaataacaacagaaaccctgacatatatacagaactgatactcagttcccactggaaagagcgtctggctggcttccaccctgattgttcggtattcatgttgctaactatttaaacattttatatcacccctgcttatgttaaccaactagacaaactgtaacagtctgagatggtttggtgtgagttctatctcatgatcgtgccccttagaggtctctcggattttcctgggccagctgcttcaaaggcagatatccctcattctctgaggtccaaaatcaggaactaaatagatctgtataaaatttttgataaatcacctcttatctggaatctcactacttcctattccaaatagatttggacaaaggagcattccttattcccaaatgtcctacccaaaccccattgaacttggaaataaacagctttggatagtgagagatagctgtgcttggtcacgtcatgccatataccacaaaatgtcctggaaatgccagtatctttgccctcccgctttcaattgtcaatggcagccacaggaactcaagggagaacacaggccttcttggctcccttgcccctgtcgtttcagcccccacaggacgggggtttgactcttcctaacagccagggtttctcttgccctcaggggagctcctccctaccagtcagtgaggttcaaattccttagcctagctcatagcccactctccttgccagtgctatttcccacaatgcctcatgctcctgccaccagtctgcctggggctctttgcatggaacatctgacctctgcatcttagtccatgatgttctcaccacctggaccaaatatcctgcatgttcaatctagtccatccttgaagaccccatgcaaatgctacctctttaaagcctgcaagttcccagattatcggtaatcttgtctgtcctctgacccccactgttggcttatttatatctcctctccctccctttctcaactgtaagtgacctgaggatggggcatgcctcatctctgaactctccttgtcctaataaagagccatgcacataagtggctttataaatgcctgttcaatgaagtaatgaatgagacaaaatcactaaaagttgagtcatcctaggaggcttcagggagatcagatttgagttaggactgaaaaaagcttaagcactgaattgggagagaggaggaaaaaaaaggcattcctgagagggaaacaaggagagtaaaggcatggacgagggtaacaacatcgcttgtgtttgcactgagcttttcaccacgtgaaaaccccctaaaaagaccaactggactagaaaggcggatttgtgttgaggaaacggtagcctcggttaagtaggaaaatagagctgaccgaaggagggccaggaaggcaaggctgagtacttggcactacagacaggaaacaggcagccaagatggaatctccatcagagggtgcagcccaggtcatgcagaaaaactgtcttctttccagagggaaagggaccaactactgtagtcagatccccatccagcgagagaaaataatgccacctcgcatttgctcccagtgtttcacaacttagccgttaatcatcccaggagagtcctaaaacaactctgccaggagggcggagagcaggtataattatctcggtgttacagcgtggaaaggctggcaaaattcccctcctgctttggaggaccccaaaggagtggaagagacggggaaggactgatgtgcaaatttccggtccagctcatctgctttggagaacttacctctgtgtatctgtctagtgtaacaatggctatgtcacttactgcggggttattattaagctgagctgtgagtccctctgtgtgctcaatctcgcctacttagacctaaagagggggcaggaggagggaaccagaaccagcagtggagctagactgcttttaacccagagacagagaaaaaacaaacagctctttaaaaacacaatttctaagcatactaaaaggtagcaattccagcctaaaagcctgtcagcttagcaatgcaccaccctaaagaaagggcaaaattatcaaggcatagaaaagcaagagacatcacgctgtggataaaggaccctgctctatgccaacttctaagtaagacgaggaattacagtaatccagcccacagcaatttcccattttaactgatgcttcctgttttctatgctgggcatcataaggatattcagaaccaaacacagcgttcacaggctgtcccttcactggggtacattcttttctgttcactcaccaaattgtgtgcaacattacaaaccaaaacagatctgttttcctactgacctcaatttgcggccaccattactgttgctgagaaaattcttggctctgcatggcagagcgggggctcctaccaacacaggccagcatgaaggcctagggagaacagctcatttgcccagcagttccctgggcttaattgcccttgaaacacagtcgggacgtgctggtaggtgtctctctgcaggcactgtccacatcaactggagtgacttgattttggaggaagggtgaggggcagaggggatggagacctcttccagtccttttagtgattgctgatccatcccagagtaaagcagacaactgggttttctgtttgttttgtgtttgagtgcaggacaatgaaggtagggctgtttaaaccatctatttttaaattcaatacaacagttacacaaatatacaaagaattcacatacttttttcttttttttttttttttttgagatggaatctcgctctgtcgcccaggctgaagtgcagtggcatgatgtcggctcactgcaagctccgcctcccgggttcacgccattcttctgcctcagcctcccgagtaggtgggactacaggcgcccgctaccacgcccggctaatcgcccggctaattttttgtgtttttttgtagagacagagtttcactgtgttagccaggatggtctcgatctcctgacctcatgatccactcgcctcggcctcccaaagtgttgggattacgggcgcgagccaccgcacccggccaggaaatttaacatcgatagaatactttttatacaagtcaatattctaattttattatcccaatcatgtcctttattacttattttttcccctggtgcaggatcatgtaccacatttgtcagaatttttttttttttagagacagggtcttactctgtcacccaggctggaatgcagtggcacgatttcagctcactgcaacctccgcctcctggttcaaatgattctcctgcctcagcctcctgagtagctgggatttcaggtacgcaccaccacacccagctaattttttttttttttttttttttttagtagggatggggtttttgccatgttggccaggccagtctcaaactcctgacctcaggtgatctgcctgcctcagcctcccaaagtgctgggataaaaagccaccatgtctggcttttaaaatttttataattttttgagacagggtcgtgctcttgtggcctgggctggagtacagtggtgcgatgagggctcactgccacctcgacctcctgggctcaagtgatcctcccacctcagccctggagtagctgggactacaggtgtgcactaccatgcttggctaatttttttgaattttagtacagatgaggtctcactatgttgcccgggttggtcttgaactcctaagctcgagtgatcctcccaccgtgggctttgaaagtgctgggattacaggcatgagttttcctttgtcttttatgatggtgacattttaaacagttcaggcaagttattttatagaatttccctccatttgagtttgcctgatatttgtcatacttagattcatctttcacatttttgactagaattctaggcaaataattttgtgtccttctgagggcatgatgtccagaggtacatgatatttgtaggtgatattcactttcatcatttggttaagtattttccaacttccccactgcgtaatttttcctattacaaatgcaaagtgatttgtggtgagatactttgcgactatgtaaatatcctgttcctcatcaaaccttaagaactgactgaaaaaatttacatttacaaatctagttatttggtaccctgggggaatgtattaaactccgaaactgagtttttcagacagtcaagggccatggagtatgtgtttgggcttcttagatacatgacttcctcacagcccgctgagttccagagaggctgaggttgcccgatagctgtgccctgatcagtgatactgcgttctacctccacaaggtgtgaaatcatgcattcctagaagctgaactgaaaaccagaactatgagtcaaggtgattcttaatggcccagacagcactgtgggaagaggcatagaaggaaatcaggtctgtccatatgcaaagctgctatgtgtgggatgttcacgtctggtttcctccctcggggtgcctgtgaacctcacccctgctccaatcctgttccccctctcttccttgactacagtggcattaaataagaacctatttaaagggtagaaatggaaggagttctttcagaccagatcgcttaaatccaggtgaggactgggggtaaaggacaacatgagtgaaaaggatggagtccaatcattcagttcaaagaggttgccaacatctgtccttgaatcacaaagaggaaagttcttctctatgcccaacctttgattcccgccattcttgtttccacaagggaatctgctgccacctgggataaccattaaacattttctttttgctaaaaattattgtgtggaaatattacctcagatgactttgttatacaagaaccaccacttccacaactacagtgactgggatagatcctcagaaaaaaagcctggtctctatggcaaattatcacagacatgaaggccagtgagcttattcagaggccaaagattcttgctctgccaatattacggccacatgttttacaagcctggagtccatttcttaaaggtatgtgtgtaggttcgtgattttaatattaatagctactgctgacacatcactggaaaaacacaggttttccattttgacggtaaaaggtttacatttaggattcatttatccctcccttagcttgagtaatgagatacaaattactggtagtgccctccaaaattcctcaggcttcataaacacaaacaggaattggcaataacagtaattacagggatggcattttttaaatagccgccgcactcttgtggttttctttcctgaactgcatcctatatttttcatttattcaatcattcactgattcaatcatttcacctagtcaacaaaacttatgttaggccttggggataggatgatgttttaaaaagatacaaaggtttacaaattaattacttaagtctgcatttatagttccactgtgaagaaatgggctttgttgccataagattcaattctttcatcttctaaaaatcctgagtgagctatgaagaaaaagaatataaatgcaattcactccgaagtgtgaaatattacccctggctaccaggtaagctgagaagactgtgagttcacacaaatcattgatctttcttgacaactgaatcctaacctgatgaccccatttaaagaaactctgtagtttcattttagaaacaccagcccaaattctgacgataattagctctaatcatcatttatgccatttaaattaagttgattagattttccctaacaattttccactcagaagttgctattttaaaaatctcaatgcccagctgtgagacgcacaaatttggtgtgaggtatgtgataccatctcctatctggcaaaggttttaaatatcctaactggaacccctaaatctttaatgtaatgtaagatctccgtgagatatactttgtcaccactgagaagctaaaagggcatttgagcaactgttcaccacaaaccagtcagctactttataatttatcatctggtgaaatcctaagagcctgggctttgggtcctcttgaatctcttctagatgaaaatcttgggcagttcttcccaaccagcatgcctggcaatgaatgccagtccctaggaaaaggctgaagggggtgctgggttttcctgttcccatggctctgcctgcccagcacgcgcacacacacacacacacagacacacacacacacgcacggtcatttctggtgcacacaggcacacacacacggccatttctggtgtgcacacacacccccattcccatttctgagtctttattggcaaagatacttctagaggcttagaaccactggacactcccacaaacatcttcagacaccaccctccccacccactgctatttccccactctgcccgctcattctcagacctaagcacaagaggaagtgagtctacccatgatgcggtcacactttttgaaacctggaagtgggccacatgttgtaaaaggaagctgaacgctggtgcactgatctagaaacctgtgatcgccttctagctataaatcttccggggttcccattaaaaaagaaattcccaaactgcccctcttttgttggagctatgattatgaaaaatcctgacaggctttcttgaaggtctcacaggctagctctaagaagctagccaaacgataaaatcacaatcataacaaactcttggaggagggagcttattgtatatctttctttttttccttttttttctttttttttttttttttttgagacagagtattgctctgttgcccaggctagagtgcactggcaccatgccagctcattgcaacctctgcctcccatgttcaagagattctcctgcctcagcctctggagtagctgggattacaggcacatgccaccatacctggctaatttttgtacttttagtagacatggtgcttcaccatgttggccaggctggtcttgaaatcctgacttcaggtgatacgtctgcctcgacctcctaaagtgctaggtgtgagccaccgcacctggcacatttgttttcctttttaaattttatcagtggcagcctctgaatcctcaagatgtattaaaaatgtcttcctaattaatgtctccactctcttttgaggaaaatatggattcaacaataagaatgtatctttacatctgagcatttaaaaatagattaattctcccatttatactatagcaacttgtagtcaacaaaatttcccttctcttttcctcagaaatgccctcattcccaggaaattttaccccagtctgctgggagcaggaacatctctgtgcaatcctgaaagccagccttcttttgagatgccctcatcccctcaccgactcaacagccctgccttaagtgaaagcacctaggaccctcaactgtgtctcctgggctaatgcccgaaggctataatgtttaattgaagagatcttcttggatgctgagaggaataaagtcagtcagtaacaaccactctcctcggtccttgaggcagctttattgtggctaagtccatattctgccatgacctggcagagagaagaggcttagcactggagcctgctggagcctgaagagcggactccaaattcctcttctgcgacttactactggctgggtggcccaggggattctctttaactcttttgtttccaacctcacagggttgacttccaagatagagaacgggaaagctaacctgaagatgtcatatcaatgagttattttgataacatcaagagatcatctgtgatactactgattcgtttttcctaatacataccctcatcctaattgctatgcactcaaataacttaccttcccctgccctcaaacccattttcaaactaatgcaaacagaacacctacgtaaaggtaggttcgtcccctgcctggcagaactaaagcctctgttggaggtaataagaacatggggtctggccaattctcaggaaagtcccaggcaccatgagcatcagatgtggggagaaaaaaaggcaggaaaagttagaaaagagtacaccttgaggctaacagaaaccagcgtgccaatgaggggatcagtttgtgactcaagtaagatttagggacatgtccaattaacgaaggcactgtcctaaatgtcttgagaaaaaaggcaccccaaaatagaccttctatatgatcacagacattaacatgccatcttgaaatggcaacatactgcaaaagaatgctgacaaggtgagacgcggggcagtgtgctgggtagacaaggccagtatttagaagtcagaacaccttagctgggtgaccactgcagtcacttaaggccgcttagtctcactttcctcatccatgacaagggtgccacaatctaactcatgaggccaggaggaaaagttctgtgtctaggactcatctgtattattggatttcacatgtcgtcttgaccttaattagacataacacaactgattttttgactaggcgctgcatgccacctgagcaaagaaatctgtctctttttctctgaatctccagagtccatctaacacagtgcctgacacaccttggggcttgatcaattttattccatttacaactgaaaaatgaggtgtaaagtaatacattataaactctggacactatataaattatacaaatatgttaaaaattattgaaagtaaataaaagacacttgccaatttagaagctaaaaatggcattggaagttaaggactggtaaagctgtctccagtcctgcccaggggagaaggacattttgaccagggcacctatgaatacaatctcttaggccaaggcatctctagagtggagaaaggaaactttcagttgttgtctggtgagaatacccctcagaatcactccaagccacctacatattaactggttcccacacagaagaaaatgtaatgcctggctggtattttgagaagccagcttggcaggtgagttccatgctgcaaataaagtcttcagcttcagaccctcatcaagtctaaatttgattgttagaattagatgtcagcttgataaaatccatcatctaaaatgcaaaagccagcctgagcaacgtggcgaaaccctgtctctaccaaaaatacaaaaattggccgggtgtggtggtggcatgtgcctgtagttctagctacttgggagcctgagatgggagaatcacctgagccaggaggtcgaggctgcagtgagacgggattgtgccatagtccttcagcctgggcaacacagtgagaccctttcctagctactgaggaggctgaggcaggagaattgcttgaacccgaggggcagaagttgcagtgagccgagaccgtaccactgcactccagcctgggtaataaagtgagactctgtctaaaaataaagaaagaaataaataaaaaggaagaaattaaaaaagataaataaatagatacataaaatgcaaaagcaagaggcaacagtgccttccagatctctcctcggagtaagcagcataatcccacagcgagatggtatctgcgagtagtggcactgaagtgtgatcatctcgcatttgcccctctccctggctcacaaatgtgacagggaaaggcggtggcacaaaacaccaggcacagtgactgcacacaaaaccattgctcaaaagctacttgttctactgagtcggcagtgtaggactctcttctgataaaattaacaacaacagcaggaatataatggcccgtttcctggatatatggcctttcacagttaagagtttccatacacattaaagtgatgcctggaggagtatcaggcaggcgtctctattttcattttcttttctttcttttttttttttttttttagagggagtttcgctcttgtcacccaggctggagtgcaacggcgcaatcttggctcactgcaacctctgcctcctgggttcaagcgattctcctgcgttagtctctctagtagctgggattacaggcacacaccgccacgcctagctaatttttgtatttttagtagagatgaggtttcaccatgttggtcaagctggtctcaaactcctgacctcaggtgagtcatctgccttggcctcccacagtgctgcgattacaggcgtgagccactgcggcccgcctattttctttttctatatgagaaaggtgaaggtcaggtacgtggccaaggtcacatataaagcaaaaggcagggctgggttcctacgctactgtttcagttggcttctttccatctcttcacaaaactgagatgatggtaaccttggattaactggagctgaaatatgtgctagaatttccctttagacctccaaagcccagtgaaatttttataggtgctactagaaaaaggggctttcttctaattatttaggtatgacacaaaataaatcatgtcatctttgccttctttttcctcatttcaaatggatgttgcatcatggattcagcataacttttttttcaagggggctctgctgaaactatgctctgttgcatccttagcccgtgatctggttagggcagaaatgcccgggaatcaggctcttggttcaaattaccctccctagtacagatcaagcgggacctaagactgcaaaagtatttactgttgtcaattaagctacaaaataagctattcattgaccttggctcaaatcaaatcctagaaaatggaacttgtctttaccctgtcataatcaaaattatgggtcctacaggaaacttttttgtgtctgtgctcagaaaaaaatatgaagtggctttgctttgtctctatttaccatggtttcaccatgaccttgtccaaggtcagtgctctgtgagtcggcttatggccaacaggaagacaacatggccgagctgtgagcacctgaccagcgtcgagcaacactgtgaacgagtggtgtatagcgtccactgtcaccagttcctggaggtcagggcttgcttttttctttctcaaacaactgcctctaagcagccttcatatctagcagaatgtcaaagaagatcattccacaatttatttattatttatttatctatcgagatggggtttcactctgtcgcccaggttggagggcagtggcatgatctcagctcactgcaacctctgcctcccgggatcaagcaatcctcccacctcggccttctgagtagttgggactacaagcacacaccaccatgcccggctaattttttgtatttttagtagagatggagttttgccatgttgcccaggctggtctcgaactcctgagctcaagtgatccgcccacctcagcctcccaaagtgctaggattacagccatgagccaccacgcccagcctattccacagtaacttaaatgaaacttctacttagagaaacgaaaaatacagccagtattaaactgccccttgaactccccagcagatgagataaaccctgagtcacaactttcttgcctgacttgtctcttcctctattcagatttcctcccatctgaacaactggctcatggacagacagaggctgacctgtggcagcaattgtgagctgtgcttcctttccttgagttataaaatctcgggctttttattggacacacagttacccagaataaaaaattcattcccagcctaccatgtagtttagatgtggccgtgtgacataagtggaaggggtgtattcaagttctaggacattcaaaattaggaggtcttgatcagagcttcactgggggcccataaggatgaggacagaccaaggccataccctaaggatggcagagcaggaaaaccagacaactgcagagctacacagcagccttgaactccctccatccagaatgttaagtgggagagaaataaacacatgccacagtaacaaccaataaaactccctcgtaattacagctgcatattctcaggtgggcatttttctatttaaatgcgataaaattaaattcaaccccagaagtttttctatggcaccaggtttacacaaatcatttgcaattaaatccctttgcaatatgttagtgctcacttctcagaatccaaaataagggaaaaaatctgttgtagattattacatgtacattattatagattacctgattgtatatttctgtgctcactaattgttttatgagtatatttatggtcttttccattacatagaatatttctagttttcacctttttgtcttactctttctttctcaatagcctagggcacattaatgaaagcataaaagatactgaacgaatatatgttttaatgagcatttaaagactctataatgtaatcatattttaacatttctccttcattcactcactcctcatcctcgtctgagatactcaggttgtggatggaggaaaatatatgcctcagctaaatggcaaattgccatggggttgctccacaggttggcaaaacctcaaatgctaaatttgtgagtgccaaggatttaaatatataaaatgcctttatttgtgaaaggtctcaaaggactttgctcattgttgattcatcatatcccttaggtttgcaaaaccatttgcaatttacaaagtactttcacactcatcatctcagtccttggagtcaggctggatattagggactgacacgttatcaacaaggagccaagatggtgaggcacgcctggtgctcatgctcatgagttgctcatgatgtcattcatctcaaaaacctggtgtgtgaatggccctttgggttattttcctggtctccctgttatgagcagcgttgcagcaagcgttctcattcctgtatctttgcagccttgagctaatacttctgtgggatggacttcaaagtggaaccgctggtcagagacttgagaacgggatgcaagcatatagaaagaggcactgggaaagtcttcctggcaggaaaatgaaggagagcaccaaagcatgaagtacaggaggcaggcctaacgagatcatcatttccagcttttatttaactgaaaatgtaggctattgcttcccagcttcagagtgaaactaagtccaaggggacatcacccagggagctgctggtatggcctgggcattggaactctccgggcatctccagtggcacatgagcataggctacctcaccagatccctcagcagctgcaccaacaccctgggcccggggaggatgaggttccgcacagtcgttttctattggaaggagaacacgcaggagctttggcttacagacaacagcagctgggcagctggggctggccaccatgggaaagggacagagcaagaaccagattctgtcaactttaatctacgttaatcctgcttataattctgacatttccttcccaccttcactctcagggtttgcttcatagactctaagacccctaatctagctatttgggtgagtatattatttgtaaatgattccaatgagtttagtttttgtttttggttttggtttttttaagacggagtttcgctcttgttgcccaggctggagtgcaacggcgcgatcttggctcacggcaacctctgcctccagggttcaagccattctcctgtctcagcctcccgagtagctgggattataggcatgcaccactatggccggctaactttctatctttagtagaggtggggtttctccatgttggtcaggctggtcttgaactcctgacctcaggcgatccacccgcctcagcctcccaaagtgctgggattacaggcgtgagccaccacgcctggctccagtgagtttaaaacaaatccttggggctggcgcggtggctcacgcctgtaatcccagcacttggggaggccaaggtgagcggatcacttgaggtcaggagttcaaggccatcctggccaacatggtgaaaccctgtctctattaaaaaacaaaaaacaaaaattagccggatgtggtggcatgcatctgtagtcccagctactcgggaggctgaggcatgagaatcacctgaacccaggaggcagaggttgcagtaagccaagatcatgccactgcactccagcttgggtgacagagtgagactctgtctcaaaaaaaaaaaaaaaaaaaaaaaaaaaaataggctgggcatggtggctcacacctgtaatcccagcactttgggaggctgaggggggcagatcgcctgaggtcaggagttcgagaccagcatggccaacatggtgaaacctcatctctactaaaaatacaaacattaggctgggcacaatggctcacgcctgtaatcccagcactttgggaggccaaggcgggtggatcacctgaggtcagcagttcgaaaccagcctggccaacatagcaaaaccccgtctctactaaaaatacaaaaattagccaggtgtgggggcccacacctgtaatcccagctacatgggaggctgaggcaggagaatcacttgaacccgggaggtggaggttgcagtgagccgacattgcaccactgctctccagcctgggtgacagagcaagacaccatctcaaaaaaaaaaaaaaaaaattagctgggcatggtggcaggtgcccctaatcccagctactcgggaggctgaggcagaagaattgcttgaacccaggagacggaggtcacagtgagcggtaattgtgccattgcacttcaacctggtgacaagagcaaaactccatctcaaaaaaaaaaaatcctctagagggatttgtttattatttatttattatatatttatattttagccccagagaggcagaattgcagaaagagctctgggcctcagagagtcagaaaacctgttcgattagctgggcttggtgacgcatgcctgtggtcccagctacttgggaggctgaggtgggaggatagcttgagcctgggagttcggaagctacagtaagccatgatcacaccactgcactccagcctgggtgacagagtgagaccttgtctctaaaaataaattaaaagaaaaaaacctggaagaaagaagagaaggaagattgatggggagggagaaaagggatgattgtgtactatgcactagctctgagcccggcaccttacatacattaactgatgtctatcctcagagtaatgctacaagaatggtgttgctgctccatttactgaaaacaaaatgaagcttccataagttaagtgtctcctcacaatactacaacccccaaaaaagcaactaaaacaacaacaacaacaaacaggacttgaattttctgacttgtcaaaggattttccattgttccaagattgctgtgtaaactaaacagatgcaaaaactgtttactaaatgctactgaagaataacaggacatcatgatggtgatgccatgacctgcaacacaggttcactaagaatttttgagtctccctggaggtcagccagctgtgtattctcaggctggacgacggccctagaaccgccttgtgagaagtccactcagtatggcagtagctgccattccctgagacatctacactccgtttagagaaatcttcccagaaaggccaaatgtgtgtctttctgcctttaaaatatctttattcacatgcatttctaaggttgcccttcggtttcttccatatcattttcacctttttacccttcttggcagcacataaagcataacttaagtgggtagagacaaagagaagcttgtctggataggccttcgtatatactgatagggattatataccccacccaccacatttgtaaataggctaagaatcacccttgatccttcctcccactacatcagatcttagtggttctccttcagacccacccctcgactactcccctttcctctctgttctcacagccactgccttacttaaggtccccttatttctcacctgcaatagcgccctaactcgtctttttggtcagttctccacagcctgctgcttaggtcctgtgcaccttcccttcataattacttaagtgagctgctagtattacttactctaggtccaggcagcttcctagcgctcacgaagaacacatgacactgccaagttgaccagcttgagtgtggcagcaaacccactgcccccttgagtcctaaaatgataaggtgcagcgaagtgtgtatctgttgtgggttgcactgtgttgcctccaaaaaagacatgttgaagtcctaggccacagtatctgtgaatgtgacctaatttggaaatagtctttgcggatagaatcaagttaagacgaagtcagcaaagcgggccttaatccaagataactcacgtccttaaagaagagaagagacacagaaacagacacagggagaaggtcatgtgatgatggaggcagagattggggcgacacagccacaagccaaggaatgccaaggctggccagcaacactagaagctgagcaaaagcatggaacagaatctccccaaccttcggaaggagcgtggtcctgatgcccatgctgattttgaatcctagccttcggaattgtgagaacacatttctgttgttttaagccaccagttcatagcaatttgttaaggcagccctaggaaatgaattatagtatctaaagaaaggtgggaagggctgaccaccaagatgaaacaagccttcgtgcccaaattcctctgcttcaccaagttgcctttggtagtttcgtatatatactctgtaagaagctagtggtctcagaattatggttctaaagaacaaatgtgattttgttaaaaacctccactttctgtaggacaaattccaagcaagcccttagtgtgccatgtaagccctctcaagtctggccccaacctgcctgtcccacgtactcatgtactcatgatcatcttccccctccacttccctgcctgcatgctgacctccagccatcactctgccctggagtccagcaactgattctcatgcacagtagacaacaggcatggtcaaggcaaccatccagggtggccctggatgtccatcataacgagcaaaaccacaaggtccttactctagaacagcagtctccaacgtttttgacaccagggacaggttttgtggaagacaatttttccatgacagtcataggagtggaacggtttcaggttgaaaccgttccacctcacatcatcaggcattagattctaataaggaacacgtcacctaggtccctcacatgcgcagttcataacagggttcgggctcctatgagaatctaatgccgccactgatctgacaggaggcagagctcagacagtaatgctcactcatgcatgcttacttcctgctgtgcatcccagttcctaacaggccacggaccgtattgcccaggggttggggacccctgctctagaagaccagaagtttgggcagttctgaagcaggcagaaggacctgcagctttgggcacagaaatcacatgagtttaccatataagaaccataaagcttaatttggtgggtatctctggcactatatatcaggcaagcccagttggtgttataggcaacgttatgatttaaacgtgtcttccaaagttcatgtgctgaaaactcaatccccaatgcgacagtgctgaaggtagaaaaagggggaacctttaagaagtgactaggtcatgaggactctgccctcataaataaatggatgctgttattgtgggagtgggtttgttttaaaagtgagtgtggccctgtcttgctatctctcacacactttctcactctttctcgtgcacgcacttgccatatgttgctttctgccgtgttgaagcagcaagaaggccctcactagatgcagcccctcgatcatgaacttcccagcctccaggaccaggagaaataaaattccttttcattataaattacccagtctgtggtattcagctatagcaaaccaaatggactacaacactcagcaatatattttctctcttaattcactttgaactttcatcacaaaataaataattgagtcctgtgcttggctctgtgctaagttcaagaacacacataagagcatctaagggatgatcgtgttcacaaatcaaatcagttcagtctagttgggaaaacaattatcatgcatcaatctgagcatactacaaggcaacaaaagaaattttagggtttcatttttacaactgaaagagttcagagaagagaaaagatcgtgtgcactaatcaggaaaggttccgtggaggaacaggaacttgggccgagcctggaggaagcagaggactcagccactgggacgagggggactttccagggacaacacaaatgaagaaacagaagcataaaggagcagctgtcactactgctgtgaaaaaccttgcgtttagagcaccattctttgttttttaagagacagaatcttgctccgtcaccctggctgttacaatggcatcatagctccctgcagcttcaaactcctgggctcaagcgatcctcctgcctcagcctcccaaagtgctgggattaggcgagaacaccatccttgatcatgctagttcacaaaatggggcccccaaaccagcagcatcagcaacaccaggaaacttgttagaaatacaaagtcttggctgggcgcagtggctcatgccttgtaatcccagcactttgggaagccgaggcaggtagatcatgaggtctggagatcgagaccatctggctaacacaatgaaaccccgactctactaaaaataataataataataataataatacaaaaaattagccgggcatggtggcatgccacctgtagtcacagctaatcaggaagctgaggcaggagagtcgcttgaacccgggaggcggagatcacgccattgcactgcaacatcttgggccccaccctaaacctgctaaatgagatgctctgggcatgggggtggggcccagcaatctgtgctttaacaagtcctcccgtagattctggtgctggctaaggcttttgagaaccactgctttagtgagaagacttataaataagtttgtaattatctattcctacagaagaaacattgaaatcatctccaactagatttcatttagctcttgatataacccaaatgggggtccacatgaagggagagtcagtatatggacatatgtatcccccaacacacacacagaccaaatcagccacctgactgccaggaagcaactgttaatacgcatctgaaggatatttggaaaaattcattatttaaggaagcaacacaggtctgatgtcatggttctatgggacaagaaatcttctgtactaacgataaagtgacttaattgtggttatctaggaccctgaaataataatgggagtacagatgcaactaccccacccccgccccacctccaacactccatcatctttcagtgatcattctgtggcatgttctcctatctcctatgctcacatcctagagatgagggtacatgctcttttatttcaagctcttgtttctgagaacctccagcaattcccaacttccaccattcctgccaaatgaaggctggatttattttgatttgtgttggctctgtagccccttgttaagtaaactaggactctgtgtctggccaatgcattcacgaagagaaaaatagaaggaatcaaagtgaattatagggagagagggagggggaagttccctggaagtctaaaagtaggaaccaaggatggtatttttggcttgggactttctgtaccacatgaaattatgagaatgacttaattgctcctgtgcattcgaaacctgagagagaccataatggctgggttacgcccagactgactggaacaggagttagacagcgtggcctcctgccagctaaacctgctctgcaaacacaagtgactgcatcattcatgctttcaggcctgggctgagtctgatgatggccggtgttgcttttcttcctcaatctccctggactagacagggcagagtatgttacagaggactgtcattttaggggtagccagaggggcagaggtgggctccagaatcctttctctacctcgctatgtgcacttaggcagccacttaaaccattctgtgcaccctagtttccccatcccctgaatatgaatgacaactctgtgccttaactatttcacacaatgctggagagaataaacttgagaaaacagattcaaagaacttctgggaagtgaagattgttatactattgatagttattcctggactctcttgttttcacacagtgtcttttgcatccctccttcccacatactgtgagggatacctattgagttgcctgccctgattccctctctgcaggaggtagcagccatgatggttaatgccaccctgccacctggtcacaggagaaggcctctgacccaagccagaccaagtgatctcactcccagaaatggtataatggaaagatttagggactgagtggtcagtggcttaggctcattatacaacccagtgattttcactccggggcagctctgctccccagaggacatttggcagaatatggattcattcttggtggtcagactgaggagggggtactactggtatctagtgagtggataccagggatgtagctaaacatcctcctatgcacaggacaaacctccacaacaaataactctctggcctaaaatgtcagcagtgtcaatgttgtaaaaccctggcttaggtgactgctggaggtagaggggctgaggaggaggcagcttccatctagctccagccaattgttaccacaggcggggtggcaggaggaatgaggcctcaaggttgcctggtctgatttttctagagaagctggaaatctggatttccatgagtaaccttttgatttttaagcaccagctcaatttttaataaacgtatgggccaaataaatacatctccaggcctcatggagcctgggggccaccagcttacagcttctgatggggagaggagacccaaagtctcctttacttgagctttttgaagctatctggcttctccccttccttggatgttgtgaggcaacagaccatgatttttttaagtaagttctctgtgttgcctaaacaatagcttccattacatgtgcccccaaaagccttaactagtacacaactcctacctgtttctctcccactcacttctttggctacatgttttgacctgattgccatccccatccacgtaaaacattttaatctcagaactggaaggggtcttacgaaaggtctactagttagggtgggcgggggagagtattaggaaaaatagctaatgcatgctgggcttaatacctaggtgatgggttgataggtgaagcaaaccactatggcacacgtttacctatgtaacaaacctgtacatcttgcacatgtaccctagaactaaaaattaaaaaaaaaaaaaaaaagtctagttctgatctgccaagaaataacactgggtaagttacttaacctctctgtgcctcagtttcctcatttgtaaaacagacatgatacttatatcacttcatcagactgtgaggaagattgaatgagctcttgtatgtgcaatgattagttaaaatgatcacattaacctcttccttgaattctttgcctttggaaataatgccccaatgctgctgctgttgctgttaataaaaatattaaaataagcacacttagattaagattggtgtttatatttgtctgaggcttagcataaaaacttgcaaaggtggaattagagcactaacttgaactttctcagtgacaaataagctgcgatccatcagcttactcagacacgtttttgtaacattttgtagacactgaggaatacttttgcactgaggcacccgtgggccaacaagtaccagagtggtttggctcgtggtgattctgagaaggagcctgagcagcaggagacagagcaagtaaggaaagggcagctgtcaaaccatcaaacctccacttgcaaaaaccgaaaaagcatacaagaaattcttgggccagagtgcaacaatctctcaccatctgaagaatttagtgtatccaggtttatggctaatctaacctgtcacaagggctgtggctttctttgctgaagccaaatcattctggcctgaattcttgccaataccacttgaccctcataaaagtccttgacagcagagtggatgccatttttcccttggctttgaaaagcttccttgccggcacccattacaaagagaatagggtctgctctccagactggaggccaaaatgctaattaactcatacccaagtctgccaaaaaaatttgtgggcagcactctttcttcccagcagtcactattatagcagtattatagagagaagagaaagaaagaaaacgaatggaaatgaataaaagccagaaagaattctgatattaagaccaaataactgcatacgcttttttacatttgtctttcctacattatttattttttatttttcggaagtctgatcacttcttgcccatataaactggtctttcaattataaaatttatcttgtcatgtacggattagacatcaatcctcttgctttccatagcgaacttcacagaggatttatgtgaggtctacaggatccgttagcaagtctttcaaaatatttctatgaaaacactgtgctttgtaaggaagatatcatacaaagcaaataatgcaactatagcagggaaataaatctggaatccacccaagtacctgtgaaagttggtattagtaagataccactcctaaatgtaaataacttcccatggtcttatcagcagcagagctaaataagatgctcttatttagtaacctcagtagcccaggaataatctagagtattaagttgtcttcttgctaggaatagcttcctccctaggcagagaaaaaagttcacctgatgtttgtatatgccaaaaggggcatgtacattccaatctttatccgtctatctatcatccatccatctactcgataaatattgaatgccaattaatggtccagatactttgctataagttggcagatagagatgaacaaggcacacacattacctgccctcatagagcttacagtccaataaggcaaacacagaagtaaacaagcaatgctaacagtctgataagagctgtgtatgctaagacatacccttttctccctcctccctaaagaaacctggaacaaggtgccaaaagctggtaactaagtagaatttaatctggcatgagtcatgataacatgtaggatgcttagggtaaactctaaactcacaatcactaagggcaacgcaacagagaaagtgatttgggaagacagcagcaacaagagacctccataaagaaggctcttgtggtagcatatgcaagatgaccactcaggccaaacctagtatgactatacaaactgttatcagaggggcagtgctgatagtttcagtttcaggactgccccatattagtgtgaaagtctgggtacaggtggaatttctgttcttcggaacagtaaaccctgtgtaagaaagggaggcagaactgggggacagatttaggagaacaaattttctggcttgtcagggcctaggggtgctaaagatgagcaatggaagaagagatggagagaatgctggtgtgacagagcgagggcgtgaaacagtcaggaacttttctaagtccttcatgtgggctaattcaatatttacaattgagctacataacctcataaggcaggcacaattattgtcacttccattctacagatgtggaaactgaggtagaaggttatgaaatttgtttcaaggtagctagtaagtcatagagccagaattcaaacgcattcagcctggttctctagttcagtggggcagaagagtttagatctgcctaaacagtaaatggggagtcactgaggatatttaatcaagacactgtgtaattacaattgcgatttcatgagtgcatgtggtcaccacatgtaggacgaaccagaggggaaatggaagataaatggcatttaatgaatgcctctggtatacccaggcctctccagccattatcttacaatcctacctcattacccaacaatcactctagaagaggcagacatggaggtcccatcttcctagtgctggaactaagtctcgaaatgcttcaatgtcttgcccatacactcctgtatgcaatagaattgagcccaacggagactaccatgaaagcccctgcttttcccaccacactgtcctggaaatgctagacacaacaaactaggtagtggtttttataattgtcaaagcaagtggtcatgagaactggaggactaaaggatggtagacttgataactgatcagacatgaaaatcatacaagagattaaaaccaaaaaacaaaaaagatttcaaaattattagtctagaagacttgcattgccagtcatagacatttggaagttacaaaagaggaagatgtttttgttttactgcagtttgggggtagagagtagtagaagcctaccagaatgttgactaaaaatactaacatttattgagtacttactgtttgccaggcagtgtactaaggacttcacgtgcaccaattaatttaatcctcacaaaactctttgagacagatgttgttattatccccattttaaagatgaggaaaatgagaaagtcactcaagattacacgaagagtaaattgcaaagctggacttgaacccaggtctatctgacttcctgtcttatagaaactgggcattttaagcctcagagaagacatgacagtgggttaagaagacttgcatgactggctcatgctagagaagcagaaccagtatgaatgggtaagtgtcattttaaaatatattttagtggctgggtgtggtggctcatgcctgtaatcctagcactttgggaggtcaaggcaggtggatcacttgaggtcaggagtttgaaaccagcctggccaacatggtgaaaccccatctttaccaaaaatacaaaaaaaagcctggcatggtgacaggcacctgtaatcccagctacttgggaggctgaggcaggagaactgcttgaacccagaagccggaggttgcagtgagctgagatcgtgccactgcactctagcctgggcaacagagcaagtctccatctgaaaaaacgaaaaaaagaaaatttagttcaaacatgaagtttctgtaataacttttctgtattctaccttgaaaagaaaataaatgcatattttataattattataaaataatgcaattgccctgacatttctagtaagtttagctgctcaaaaataagcaggcttggaagttttagccagagctatcaggcaagagaaagaaagaaaaggcaccaagataggaaaagaagtcaaactacctttttttttttttttttttttttttttttttggctgatgttatgattctgcacctaaaaaaccccagagacagccaggcacgggggttcatgcctgtgatcccagcactttgagaggccgaggcatgcggatcacctgaggtcaggagtttgagaccagcctgaccaatatggataaaccctatctctactaaaaataaaaaattagccgggcatgggggcatatgcctgtaatcccagctactcaggaggttgaggcaggagaatcacttgaacacagaggcagaggttgcagtgagccgagaccatgccattgcactccagcctgggcaacaagagcaaaactccgtctcaaagcaaacaaacaaacaaagaaagaaacaccctagagactcctccacctcgaactgacaagtgacttcagtgaagttcacgatacaatatcagcatacagaaatcagtagcatttctatacaccaatgacattcaagttgtgagccaaatcaagaatgcaatcccattgacaatagcaaaaaaactaaaatacttaggaatacatctaaccaaggaggtgaaagacaactataagaactacaaaacactgttgaaagaaatcacagatgacacaaacgaatggaaaaaacattccatgctcatccattggaagaatcaatatcgttaaaatggccatactgcccaaagcaatctacagattctatgctatttctatcaaacaaccaacgtcatttttcacataactaaaaaaaactattccaaaattcctatgaaaccaaaaaagggcccaaatacaaaagcaatcctaagcaaaaaagaataaagccagagacatcacattaactgactttaaactatagtataagggtacaataaccaaaacagcatggtactagtacaaaaatagacacattgaccaatattctgttctctgttctgttcaacagagaacccagaaataaagctgtacacctataaccatctgatcttcaacaaagttgacaaaaataagcaatgtggaaagaacttcctattcaataaatggtgctagggtgcttggctagccatatgcagaagaataaaacttgaccctacctttcaccacatacaaaaattaacccaagatggattaaagatttaaatgtaagacctcaaactataagaataatagaagacaacctaggaaacaccactctggatatcaatcttggaaaagaatctatgattaagtcctcaaaacaactgcaacaaaaacaaaaattgacaggtggaacctgattaaactaaagagcttctgtacagcagaagaaactattaacaaagtaaaaagacaacctacagaataggagaaaatattcacaaactatgcatctgacagaagtctaatatccagaatccttaaggaacttttaacaattgaacaagcaaaaaaacaaacaatcccattaaaaaatggccaaaagacatgaacagatacttctccaaacaagacgtacaaactgttaaaaaaatgaaaaaatgctcaacatcactaattatcatagaaatacaaatcaaaaccacaatgagatacaatctcacaccagtcagaatggttattagaaagtcaaaaaacaacagatggtggtaaggctgaggagaaaagagaacaattacacactgtaggtgggagtgtaagttagttcagtcactgtggaaagcagctgggagatttctcaaagaacctaaaacagaactatcattcaactcagcaatcccattactgggtatacatcgaaaagaaaataaattgttctaccaaaacgacacatgtacttgtatgtttaccacagcactattcacaatagcaaagacatggaatcaacctaggtgcccatcaacagtgaattggataaaggaaatgtggtacatatataccatggagtactatgcagccataaagaagagcgaaatcatgtcctttgaagcaacatggatgaaactgggggctattatcataagcaaattaatgcaggaacagaaattcaaataccctatgttctcacttaaaagtgggagctaaacattgggtactcatggacataaagatggcaccaatagacatggggactactagaggcaggagagagggaggtgggtaagaactgaaaaactagttataccccatatctacaaaaaatacaaaaatttgccagaaggctatgtgggaggctgacctgggagaatctcttgagcccaggaggttgagccgagatcacaccactgcactccagcctgggtgacagagtgagaccctggctcaaaaaaagaaaagaaaagaaaaactggcagggtgcagtggcaggtgcctgtaatcccagcactttggggaggccaaggcaggcagaccacctgaggtcaggaattggagactagcctggccaacatggcaaaaccccaactttacaaaagtacgaaaaaaatagctgggtgtggtggcgggcacctgtaatcccagctacttggaaggctgaggcaggataattgtttggacctgggaggtggaggttgcagtgagccaagttcacaccactgcactccagcccgggcaacagagtaagactctgtctcaaaaattaaaaaaaaaaaaaatagaaagaaaagaaaaactaactattgggtattatgctcagtacctggatgacagtaccccaaacctcagcatcacgcaatatacccaagtaacaaatctgcacatgtaccccttgaatctaaagtaaaagataatgtgttttgtgtcaccttttcaacataagaaactgtcaccatgaaactgtatctatacttacaaattgctctgaaaattttgaccttaaaagctattttttaacttgaaaagtaaaattaaaggtaaaaaagaaacccacagcatttttcactagagaagaccaaatcttttgtggttaaacaatccagatcatatgagtgtttagtcaagtgtttttcaagttcaaagtgcttacctagcatgtgtaagaaggaagccatgagagccagagatgggctgaaaggaaattgtcctgcttacctggctattttaaaagcataagtggctctgtcagagggaaagtgaaatctaatagagtcctgacacagattgtattgattctaaaaagcacattgggaaaaagaaaaaggtacatgggttttgagtttgtttgttttttttccatttaacatatcttaaaccagaatatgtcttacaacagaagacatgtcttaatttagttagcaatatttttcttttttaaaggtatataagaaatggtgctttctggccgggcacggtggcttacgcctacaattccagcactttgggaggacgaggtgggcggatcacgaggtcaggagatcaagaccatcctggctaacacggtgaaactccgtctctactaaaaatacaaaaaaaaaaaaaaatagcctggtatggtggtgggcacctgtagtcccagctactcaggaggctgaggcaggagaatggtgtgaacccaggaggcagagcttgcagtgagccgagatcgcaccactgcactccagcctgggcgacagagcaagaccccatcacaaaaaaaaaaaaaaaaaaaaaaggtgccttttgaaatatcaatggcaaccaaaaatggaaataagattgacagaaaagaaacatctgttcctaaaaccaaactaaaccaatggttttgatgaaatatggtaatttctgaacatgaaacataaacaatttcaacaagggaattgacattcagatttaaaattaagggtgatatgggccaggcacagtggctcacacctgtaatcctagcactttgggaggccgaggtgggagatggcaaggtcaggagatcgagaccatcctggttaacatggtgaaaccccgtctctactaaaaatacacacaaaaaaatagccaggcacggtggtgggcgcttgcagtcccagctactcgggaggctgaggcaggagaatggcatgaccccgggaggtggagcttacaagaagccgagatcgcaccactgcactccagcctgggtgacagaatgagactccgcctcaaaaaagaaaaaaaaaaaattaagggtgatttggagaacggctgtgtgcatttgtctgatgactgcactgatgttgctgtgtgctacagggccccagcacactggaggggaggaggacctggaagttaagggaaaatagcaggcttgggacaaagggtgcagccagagaggggtctggctgcccataagagcccctggggggctgtcaccttatattattactagagcttgcgggatgtgtgttctgagtttgaagcagcaaagacccttcatgagcccacagtgacttctccagctccatggtgagaaagccaccaaaggcaggaaaaaaaaaaacaaaaacggaatcctcgagagagctgagattcaagatctaatctgggcaaagtgagggatcctcccttgtgccctcagttctcaagaacaggacccactttggccacaaatcataagtaagaaaagaaggctcagccgacagaacgtgagacaagtacatatatccgtgtgggcagtgaggcagtgaatgacatctaaactgttagaaaacccagactccaattaattctattctgcagtgtcctaggtctgcaagcatccaaaagtgcaagcatcagtcacatccgttaagagagaatatgttttcaaattaaaaaaaaagggagaatatccaaaagaaaatcaatgacactatcggaaagggggccacccctcgcctatgagcaacacaagtctgtggagagccttgtgctaaaccaccccaaaatgacctgcttctgggtctgggttttaaaagaaaaaaatcaggctgtctttggagttgggcatgttctggggagcatcggggatgctagagtatctgggttggttcaaggggaggaaaaggtagagaagaagcacacctcagagatgctgccagatagagctcctcaagttcaaggtgacattcttctccctgaaacccaggtgggagaaagagctgtgtctcgccgtatttatccccatcccaagccccccccccacagagggcagcatacagcagagcctgagaattattggttggatgaatgctcaagtgctgcacctgcttctttcagactgaggggacctgaggagtaaaattgagccttatgtcctaaagacattaaaagactcctaaaggccttgcttctatcagggagtaattaagacacaaagaaaaatccagatagtctcaactacaagtacatttcccatttacaaaacttcaagtaatagctggatttgtttttacttttagcactctaaggctttttagaaaaaaaaaaaaaaaagccttttgactgaagaactatcttcccttcagtagggtttaacaatttaaatgaattcaatttccttttcttttttttttttatttctgggacagaatctcgctctatcgccaggctggagtgcagtggcacaatctcagctcactgcaacctccacctcctgggttcaagcgattctcctgcctcagcccttccgaggagctgtgactacaggcgcccgtcaccatgcccagctaattgttgtatttttagtagagagagggtttcaccatgttggccaggatggtctccatctcttgaactcgttgatccacctaccttggcctcccaaagtgctgtgattacaggtgtgagccacagtgcccggccaattgtcctttttagttaggggataaaagatctccaaatgacataaccagggatttcgtggaagtgatcacagcttgactaaaggacttaaattcgtgcacaatgagtcccagtcagtaggctgtgacatcagctgaccagcacctaactgcaccacaggttgagattatttatttatttcaactccagattttatggagtttgatagtgcaatccaataacacatcttttaaacaataaacactaaaatgtatacatgtccaatcattttgttagcttttttccatgaaggaatactaagatttttaaaaattaatttagcatttcttcattatctttttaaaattaaattagttaagattaaaccattaattcctccatccactggcccaggctgggggaatactgctgtgcttggtgagcacaggagcaggtgtccatttccatggcatctgtagtgctcaatgtcagcccacgcaagtccttgagctctcaatatctgtttttcagtgtctgacctgtcaaatgcgggacatggattgactcccacagacccttccagctctaacccccatggcctataatcagggctgtccagtgaatcagaatgtggaggcatcaagaatcttcccaaagcacaaaaagcaacagctacgacatttaaagtaatgggaataggaagagggaagtcaccacacattcttcatgatcctgaattctttaaacaccaaaactctcattaaactcaaaggttcagttcctcttccatttgagtacatttgtattatcagatgcttaaaggaaaaacaaaacagaaaaaaaaaaaacccagacagctatgtatttccctgaagacacaaataattcacacttctctggaaaagcgcacagtagaattgggtgggacgggcatggtggctcacgcccgtaattccagcactttgggaggccgaggcaggcagaagacgaggtcaggagatcgagaccatcctggccaacatggtgaaaccccatctgtactaaaatacaaaaaaaaaaattagccaggtgtggtggagcatgcctataatcccagctactcaggaggctgaggcacgggaattgcttgaacctgggaggtggaggctgcagtgagccgagactgcgccactgcactccagcctggcgacagagcaagactccatctcaaaaaaaggattatttgggtggtcagtctgaacccatttttcaatttaaaatcacaagatgtttttcaatgtcgtatcgacacgtgataactgttgattttttaattattattttgagcctaaatgtctcctaaccaagagatttacattttcatgattttaccattccatttttgtctatgaaccttgcttttgtgttaaaatatgtactgctacttgcataatttatagctatgctttaattaaagatgatgtattcctacataaattcttccctttgtcaatatggtaaaaaggacattggaaacacaactcgaaagcgacctgttcagagtctacctcttatgggctgagtgaccaagacctgccccctgcccccgactctactgtatgtaaaaaggttttataaaacagcaagtcagggaaccactcagggaacagtggggagaatgtaggacaatcctgagcaccaggcttcaggcaatcaggcacctgcacccagaggaactggaacctaggtggggcttttcgggtggggtcgcagtagggaaagagaactgaagaggtaatgataccatctccctttatgggtaaggcgttttctcacttgactcttccacagagtgcacacctccatgcaggagtctcccatgtaatcctccaccttgtgtggacccaagactttgctttctattcccatggacccaccagtgcagccgtggctcaccgctgggcactgctagccttgatgcctgcttacatctccatatacctgctttttaaaaggcactttgtacatttttctttttttttttttatttcagagatggggtctcactctatcacccaggctggagtgcagtgccagcctcgacctcccaggctcaagcaatcctctcacttcagcctcctgagtagctgggaccacaagtgtgcatcaccacatctggctatttttattattattattatttatagacatggggtctccctatgtttcccaggcttgtctcaaactcctggccttaagcaattctccttcctctgcctccaaaagtattgggattgcaggtatgagccagcacgcccagccatttatttactttttaaacatcactgttaagtggacagtgcaggagggtatagtgggatggcagagagaccagttaggaatatcctaaatcatcctgaccgagaattgcctctccagctcgctgaattaggagggcagctatagagtggggcaaagctgtcagattcgatgtatttttataagcagaaataacaagatgtgctgacaacttgtacatgaaggggctgagggatggagtgaagttaaggaaaggccagggtggactgccatttccagacatgtcttgggaagggctgaaacttctcatcagtgggcaaaggaacgtttgccacattgacaccctctccatccccagcacttcggaagctgtgttaaaagaggagatggtgggcccaacagcctgggcagaagtgtggaggcttaccctgctaaaaggaggaagtggaggaaaacacaaagctccatggtgggggggttccccctctcaaaggagatggggctgggtggcagaggtgtcagcagagggtgagagaaagttcaccctgacagattaactgggcagcaaacgggcttgcaaaatgtggcctttgctcaaaccaaaggtagaatgtgagagtggagtagtacattttcttgcactggggaagtgaccttctgcttagtcccgtctacctcccagagtgtggaccagaagagagattctgcaggaggaaagagaacttgatccattgccaggctcaaaccttcaagacttctgaaaaggaacccaccttcattggggtggcaaattgaccagacaatgaactttctggcccctctcccaatacacgcttggtactgggagaggggccaaaaagttcatttttacaacctctatgaaaccccagttgtgttgttggtatctcttcatttcatgagacataaattcataaattagtattactatacttagtattttataatgaccagttatagaaacttaaaggacatacacaactccagctgtgcagagatgaccctgatcagaatacagatgttttgatcaacctgctacacatagctgttctgtgtggaggggacctcatcagccctcaatatattgggcaatctgtagaagactctggtgtggagcatgcaaggcctatagagttaagcatttagggcatgtgaaaaatctaagacactggtaagtgagtaggtcccagggctacttctacccatacgtttgagaaaactaaggcaggggtgtgttaccctcttagactctgtgggagggcattatcatcacaatttacagacaaggaaactagttcagagaggttaagaaactttgcccacagctaatcaggacagggttagaatttgaactcagcatcctatcaatgacaccatagctgcttcacgaagatgactgttatcaacagaaggtacggaggactcaaaatgggtaatgtaagtaataatgagaatattattcatgacaacagtaacaattaacattgactgaatgcttactgttaatttaacaaatgtgtgttgagctcctcactatatgccagacactgctggaggcactgggaagacagctcctccatggagcttacaatctagtaaagactcatgccaagtcccatgaattattcctcttaatcctcaagcaacactatgacgtagatactgttctaacctatattcagtgtgagagtcagagtggttaaaggacttacctaacgtgccatagctagaaagtggtgtcgagctggggccagagatcctgagaatcttatgatcaatccagttcattaggtacccaatagcaatcctaaatgtgcattgttggaggaaaatggaccaacgactcagaatgtaaacatttcgggtagccccaaaccaaaagagatttgacatccattcaaaaactgcaggaatactctaaagaacattctaggacctctgaaaatcacagggtggtgagcagcccacccaaactttcccacagtctagtgtgccttccaagttcatggtctcatatgactccatatgaaaactgccagccgtcaaatgctggacaggccaacttcctgaataaccaccactttttgattctctcctaaggtctttaaaagagcaaaccacagctattctcacttcccagaaccctttgctgattacagcgtgagatcaaatccccatggacagggcggactggtatttcaaacatgaaacactggaatgcagattaataatttaccaatgactgtaaacgaatattattcatggagggaaaaaacttctctcttttaaatgggaacccagtcagattatctcagtactttaagaagcaaactgcaaaataccttcttagaattcaatatttattaacgctgatgctttattttttaagaattaaccattcccagcttcaatattctgcttcagcataaagttcactttattctgcatgtggatttctgtattctctgcccagataaattaatacatattccagagtctggggccacggtcaatgaaaaaccacagcaaattcctaagcagtaagagatattccacatggcttgaaatggctgaaggagaatttttttaaggttaagaatcaaagtgctgtaattgaagatcttaaaatcaagcagcaaggcattctcaaggtacctaatgttgacttcaaggatcatttaaggtaaacttccctctcctcatccttccttgctcaccctcgaatccagtttccagctttaagagtggaacattgctgacattaggtcggtgatgttaacttaaattggcaatgcaatgtaaaaagtggcaggcaaagtacgtataactcaattacttgaaaaagtaaatatccccaaatattcccaaggtctgttgtcaggtttttgcctaagtcaatctataggtacatggcacagggaggtactgtaataatagtcttttgtaggtaaatttctaagcaaactgctttaaaaagctatccttgattcaacttgcaggtatttacaatagcaccctccattccatttaatattataagtgcacctgtcccacctttatgaaaatcatgtagaacaggagtcagcaaactacagcccgtgagccaaatctggctcaatgattatttttaatttttatttatttgtgttggttttttgagaccgagtcttgctctgtcacctaggctgaagtgcagtggtgcaatcatggctcactgcaactttgacctcccaacctcagacgatcctcctgcctcagcccctgcaggtagctgggaccacaggcatgcaccatcacgcccagctaactttttaaaaatctgcggagatggagtctccctacgttgcccatgctgctctcgaactcctgggctcaagcaatcctcctgtgtcgtcctcccacagtgctgagattacaggtgtgagccacgacgcccagtctgattgtttttgtaaaccaagttttattagaagacagccacgtgatttcatgctacaatggcagagttgagtagctgtgacagagactgtatggtccacaaagcctaaaatatttactatctagccttttacagaagaattttgctaaaccgatgtaggatcaatgaggaaaaccttgaaagatgtgacagcagccttgctcagtccacaggtggactcactatattatggacacagtaagtgacagggcttttaaatcacaagcaccttccttttccaacccccatctacaactggggaaacatctctgaactaagggaagagcactgatatgagaaatcagaggtcagcaacatatcagaaaagaaacaactgagaaccaagaaactgccccatatttcagatgagatgggagaggtagaacaatatatacaaacggcaagaaaaagatcagatagactctcctctcctagagatcgcaatcaacttgattatcaacaccagccccaaattgttttttattacaaaggtatgtagacacagcactctaccactccaaaaatactaagatggaaagaaatgaatcccaaattttcaacaacttatatcccttccaccatctaaatttcattaggttaacaggtcagtagcacatctttaaaaagtataaataactctgttaaagtaatacctgtcagtcattttcaccttgatgaaaattattaatgtttcaatcaaattttcttttctgtttatatgtagctagttctggctctacaattctataatttcatggtttgatttcactgcatgcagctctcttttattattgcagggcaagggtgatattcaaaagagatgaaaggaaacaaagactaatttcacagtaagggtaacgtgaggctactacaagtggaatgaagcccaacggctctcttctttagcctgaaatctaggttctagataaaaattgggatgcgtataaattaaatttaaaagcaaaagtatcctaccatgttgcagtaacttagcttttccttcctttaccattttgtgtcctaaaacaactctgtgagtagaaatagataatgtagacattatttccattttgcaaatgaggaactgtgttgtctgagaggttaaatcacttgctcaaagtcacgggtaagggagaattcaaagtcttctaactgccgctacttcttttgtgagacaaaagtgtgtgataggatttactgtgtccaagaatgctgccgatttaacgggaaggaatcctgggcttttgtacagcaacacatttaccttctcaaaattaaaaagtaaacccattatttacaaattacaacttgcaattagatgggaagaagtaagcatgctgatctaggatttccattatgtggctgacactagggaggccacgtccattctcattagaatacacagattactaacctgacagcagcagcagtccacagacaggtgtttctagatgtagtgtcccctgtgctataaatccacagcaggattgtcagtgatgtgtctgatgctacagccacataaactaactttccccatcacttagatcaggcatttttgctactactgaacagaagagagttcaggaattgactttgctggcgctctatttttttttttaatttaattttttagagacgaggtctcactatgctgtccaggctggtctcaaagccctgagaccaaagctcaagtgatcctcccacctcggccgcccaaagtgttgggattacaggcatgagccaccacgaccggccctgggattctattggatgcagccaatttctttgtcaagattggctccatgctgttatttaatcaggtgtttcctactgtgtagacaaacctaacagctctccatcttaaaaaaggagtgaggaattgagctggacagagatgtgcattccaaatttttctttccttttcataaagacttgatcgtcttatttatctggattggccatacacagtaatctcactagctgacagttgcttagtaaacacaactgaaggacaatccactaagaaatgtcacatttcttttaaactctgaaatcctatatcccagttccacatcttgcttttcaagtttctgttttaactatccagcttcatcactatctactttctttctttttctttttcttttttggagacagggcctcgctctgttacccaggctggagtgcagtggtgcaatcttggctggctgcagccttgaactcccaggctcaagtgatcctccaccacagcaacccccggagtagctgggattacaggcactccaccaccgcgcctgggtaatttttgtattttttgtagagatggagttttgccatgttggccaggctaatctcaaacttctgggctcaagcgatcctcctgtctcggcctcccaaactgctaggctataggtgagagcgaggtatctacttttgaatctagtccatctactcaccaacctcccacacccattgtgaaattactactactacccacaaccctaccacacaacactggacctatttcccattggtgagtgggtatccttcctctgagcaaatggacttcctacttctttctagatccattctcttcctgcctggctttcagcttctagtttttcatgcttttttctccctttattcctatgtttatagttgaaagctaaaccacaagagtgagttcagtaaatattttttgagcttccactatgcatctaagtaaacacttcagaaccagcatatatcctcataggaaagagctacttcttcctctgaaaccccctggaaatatgcccaggtaatagggaagcacatgaaaggtaagcgacttcctgactgaatagaccaattgcactcagttttgtggcagtggatataaaagaaatatgaagaacctctcgtcagtggggcacaatgactcacacctgtaatagcaatgttttgggagaccaaagtggaaggatcgcttgagacccggctgggcaacatagtgacactccatctgtacaaaaactttaaaaattagcctggcatggtggcacacgcctgtagttccagcgactcaggaagctgaagcaggagggtcacctgagcccaggaggtcaaggctgcagtgaaccatgattattgcatcactgcactccagcctgggtaaccaaatgagaccctgtctcaaaataaataaataagtaaaaataactaaaagtataattggaatgtttgtaacacaaagaaattataaaggcttaaggtgatggataccccatttatcctgatgtgattattatgcattgtaggactgtatcaaaatattgcatgtaccccataaatatatacacctactttgtacgcatatgttgtttttcttaaaaaaaaaaaaaaatgaccattttagacgactcctgacataaacacagaaaaatgctaccaaatgtcctccttttccattatggtaacagcatattccccccactggtgacaaagtggcagaaactgctacaggaccaaagtagaatcagatggtatcaataaaactgccaacttcatccaaatattctccaaagcttattaagtctctgaaagacgattatacagagatcacttggcaagggctttctttcgcaggcccttccagtcacaatgctgggtctttgggttcagcctggcagggtcaaaaacagaaggaaatcagagagaaatttgccaactcttccacactgactacaagaatgatttacttatcagactggcatatatgtctccctcattttgctccatccacttagatgtctcacgtacaggtcacactttcagaaacctcatagagaattgccaagcagacaaaggaagcctatttgcaaaaaacacatccaccaactcctcctcgctaagaatatccctgaagaagttctaacacatttattagtgtaaagatttaacacaaagattgtctcaaagagaacattcacaccacactgggtcaaaccgtgaaagagaaaaacaagggcattcttgtggcatctaagcctactcagaataatctttattcattatttgcatagctcatggctttatatttttattattaaagtgcaattttgacgttcaaatttaagaagaataaagaacaagatttggcaccacttggtggatatatgtactatccttggtatgtagtaaaaggtggactagcatcaaagagtgtgaaaacgactccaagctactttcagacacttcagctggcaagcgcaggctgctacagtatgagatgtaatctgccaaataccacagaatgcaagattttacggattttgaaagaagcaagtgatgattctgtggccacatcaggagagcatgttttctgcatcaataaatctgtgccgaatatgaataaaaaaaaaacccacttggttctacctcaagggctgcttttcaccattgtcccacacataagccagggctggaaaagtacaagagacccggccaggcttgctctcagatctctttgaagtcccccacctgttttcctagctacttggaggccacgatggacttacatttaaactatattagacctcatgcctcagagataggccactgctaagcagcctgagcatttatttaccaattaacttagtccggcattttgagaggtagtgggagagacacggacgcattcaaatgactccccttgagatgtcaggaaagaacctgtatcatctgaagccatgtgtggccctgattcatgcggaggaatgagtgtcacggactataagcggtgctgtctgcacacacttgttctgatgcctttccaatgagaacccggctgtgtgctgtgggctctctctggtcacacaaaaaaacaagtcctgcagcaactcaagtgtgctaccccctctcccactacacccaaaatattaacacaaaagcaaaaaaaaaaaaaaatcttgaaactttttctggaattaaaaaaaaactaggccgagtgcagtagctcaggcctgtaatcccaacattttgggaggctgaagcgggcagatcacttgaggctaggagtttgagaccagcctggacaacatgccaaaacgccatgtctaaaaaaaatacaaaaattagctgggtgcgatggcgtggccctgtagtcccagctactcagaggctgaggcaggagaattgcttgagcccaggagatggaggttgcagtgagccgagatcatgccactgcactccagtctcggtgatgggagtgaaacgctgtctcaaaaaaaagaaaagaaaaaaccctagattcaaagggacatacataaataaggtaaataaggtttatttatgtccctttaaaactagcagtcaggctttcataagtaacttttatttttaaaattatgtgtttttaatagtacttgaattttggacatgtgttggatcatctgagaattctctgatacctccagtaattcacatagtacacccctggtctttttttgttttgttttgttttttaattatactttaagttctgggatacatttgcagaacgtgcgggtttgttacataggtatacacgtgccatgatggtttgctgcatccatcaacccatcatctacatcagataattctcctacccctcccctagccccccaccccctgacaggccccagtgtgtgatgttcccctccctggtccacgtgttctcattgttcagctcccacttgtcagtgagaacatgcggtgtttggttttctgctcctaggctggtttgctgagaatgacggtttccagcttcatccatgtccctgcaaaggacatgaactcatccttttttatggctgcatagtattccacagtatatatgtgccacgttttctttatcctgtctatcattgatggacatttgggttgacaactcctagttttaaaaaaaaaaatctatgcttatataatacctccttgcagttactgaattgtacagttattgaattgtttatcttttacaaagcacttctactttatttcatttgattcttatggaggtgttttattattatgaatatttccgttttacagatgtaaaaatggagggaactgattaagatgacaagagccaggattcaaaccagggctccacactctaaatttctattgaataatttttaagtttcctaagtttactacaggtatgaaaacaaaacataaggcaggcaattatgatgaaacctgctctgctcaggaatggagttgtgttatccatatctacaactgctgagcttgattgtgatttttctaaacatgaacattcatcagatataattcgtataatataaagcacatggttttattctgttctacaatttcgcatttggcagaaaatagagctttagcctacattatgaaacttaaaagaacattcagactactatagtcaaaaatatttcgctcggctgggcacagtggctcacgcctgtaatcccagcactttgggcagccaaggcagacaaatcacttgaggtcaagagttcgaaaccagcctgaccaacatggagaaaccccgtctctactaaaagtataaaaaattagccgggcgtggtggtttgctcctgtaatcccagctactcgggaggctgaggcaggagaatcgcttgaacccaggaggtggaggttgcagtgagctgggatcgtgccactgcactccagcctaggcaacagagcaagactccatctcaaaaaagaaaaaaaaatctcgctcacagagttcttataggacaaagtaaaatctaagcttagatatatctttactcaataaggcaaatcacttaaacatcctccatacatttccctgtccatgatgtggctaatatggttaaattaaactcctttttttcctcctactcaactgagaaatgtcagcgaagagtgtaaattaatcaaacaaaatccttctaaaggaaataagctctgtggtctttgcagagtcaggtaataggtgtaactaaagtggccctatattgacaactgcattgtgaggcaaggcaagaaaaagtgttcaagtctaaaaaaaaaaacaaaaatgaatagattgcttaggaatttggtagctgtctctacttacaaatgaatttctattttcattaatataattttttataatagctatataaactagatcagtattgactttttttttttttttttgcttgaaagaggagttgaaatgtcttccacagcacatagtacgttcctgactcccagatctgtgctgagcaaactttctgagtttttcaaccttggtcaatgagaggactgtgtttattataaatccatgaagggatatcacctgctgaattgcagagaacagagaaaaatgtttcctctctggttttagaacatctcctcttaagctcgctccataaaacactcagccaaccctgcctgcaagatgtcctcagtgctgagccaggactgtctctatgggctctcaggagtattggggctggtctccaaccaccctgctaagctgggaaaaacagtaggggagtttcaactattgctaacctgtaaccacttcccacaggcaggaggagcaaggtccttgaaaacccatttgggtaaaaatttagaatgatatggggcaaacagtgcaagagaaccaaagacaggggtgaaactacctacaaaggtctatcaacatctaaaaatagacatttaaacaatgaagagtgcaccctataaataaaacatcaggctgggcgctgtggctcatgcctgtaatcccagcatttttggaggccgaggcaggtggatcacctgaggccaggagttcaaaaccagcctggccaacatggcgagacctcatctctattaaaaatacaaaaattagccaggcgtggtggcacatgcctgtaatccctgctactggggaggctgaggcatgagaattgcttgaacctgggatacagaggttgcagtgagccaagattgtgccactgcactccagcctgggtggcagagcaagactctgtctcaaaaaaagaaaatgtcaatgacacattttattcaacttgaagtagtaataatgggtactaaactcttccattttatcaaacctcaatagacagaaacctttcagagccttcctctccactggttctaatggatggtgtggaatgatacacagtgcttggatacagattttatgtgtaacaagagatgttttcctgttcctggttttctaaccaaatatttgactgaccttctggtttccaaatggagacagaaatgtaagatagcttggttatttgacgtacaaaacctttgacctaactgactccatactgtagaattggtatttctcaacttcactaccccgatattcacagtagtccagcctcctattgactgccttcatccagaacacagcccctcccaagagacacaaaagggcagctctgggcatgttaggctcccatcccagacattcttcatgttgattcatctgtgtttctctcctaatagggttgttcagtcacccagtttccttctcgttcctatagtcaacttccaattaaaaggtctccctactaagaattttaaaaattcagtccatgtatggtggctccagcctgtaatcccagcagttttgcggccaaggcctgaagactgcttgagcccaggagttaaagaccagcctagacaatatagcgagataccttctctacaaaattttatatatacatacttttttttgttttttttttttttgacagagtcttgctctgtcgcctagcctggaatgcggtggcacaatcccggcttactgcaacctctgccttctgggttcaagcaattctcctgtctcagcctccctagtagctgggattacaggtgtccgctaccacatctggctaatttttttgttgttgtatttttagtagagacagaattttgccatgttggccaggctagtctcaaactcctgacctcaggtgatctgcctgtctcggcctcccaaagtgctgggattacaggcatgagccactgcatctgacctctacaaaatattttttaaattggctgggcatggtggtgtgcaacctataatcgagaagcatgaggatcgcttgaacccaggagatcgaggctgcagtgagccatgatcgtgccactgaactccagccaggatgacaagcgacaccttgtctcaaaaaaaatagcaattttttaaaccccgcctgatcgttaaattaaataaggcaaacttttcacattaacctttttttttttgaggttctatttccgtgatgtgctgtgtttttgttttactttctctagacagtctaatttctatggactattggaaggaggaggaaaattgtcaggaaaaagtaatacttgagttggttttctatgacgtcactcactgtgtttttaccatgtgtagtatcaaataacagtagcatcaaatgacatgtttacaattgcctttgcaaataactgccgtttctaagttcattactcctcttactattttttatttctaatttgcttggacatttaatgtccaaagtaaaactaactttataatatttggtttttattcaggaataaaatcaggaaggatttaagaaaaatcttcagccaggcatggtggctcatgcctgtaatcccagcactttgggaggctgaggcgggaggatcacgaggtcagcagttcaagaccagcctggccaacatggtgaaaccccatctctactaaaaatacaaaaatcagctgggcgtggtggcacacacctgtaatcccagctactcgggaggctgaggtagaaaagcttgaacaggggaggcagaggttgcagtgagctgagatcccgccacagcactccagcctgggacagagcgagactccatctcaaaaaaaaaaaaaaaaaagaaaaaaaagaaaaaaagaaaaatcttcaaagaacataaaattcattttaatttttaatttttgggcatatataagtaggtgtatatggatattttgatacaggcatgcaatgtgtaataatcacatgatcgaaaatggggtatccacaccctcaaggatttatcctttgtgtttcaaaaaatccagtaatactcttttagttatttttaaatgcacaaattattattgactatagtctttctgttgtgctagcaaacactagattttttttttcaataacatttaaaatacacttcatgaatttgcatgacatccttgctcaggagccatgctaatcttctctgtgtcattccaattttagtatacgtgttactgtgagcatgcaaatgctagctcttattcattctattatttctaactatttctttgtacccattaaccataacccctgtctccccagttctccttcccagcctctggtaaccatcattctattccctatctctatgagttcaatacttttaatttttagctcccacaaataagtgagaaaatatgaaatctgtctttctgtgcctagcttatttcacttaacataatgacctccagttccattcatattcttgcaaatgacaaatgacagggtttcattcttttttattgctgattagtactctgttgtgtatctgtaccacatcttctttatgtgatgaatgatttcattcatcatttgatggacacttaggttgattccaaatatttgctattgtgaatagtgctaggataaacatgggagtgcagctatctcttccatatgcttatatcctttctttaaggtatacacctaccaatggaattgctggatcataaggtagctagctctgtttttagtttttaaggaaccgcccttctgttctccacagtggctatactcatttatatttccaccaacggtgtatgagagttcccttttccccttttcttcacatccttgccagcattcattattgcccgtcttctggataaaagccatttttacttgggtgagatgatacctcattgtagttttcattggcatgtctctgattttcagtggtgttgagcaccttttcatacacctgtttgccatttgtatgtcttcttttgagaaatgtctattgatatcttttgcccattttaaaatcagattagattttttcctacagagttatttgagttccttctgtattctggtgattaaacccttgtgagatggaaagtttgcaaatattttctcccattctgtgggttgtctcttcattttgttgattttttcttttgctgtgtggaaggaagctttttaacttgatgtgatcccatttgtccaaaaaatctttgcttagaccaatgtcctggagtcttcccaatgttttcttttagtagtttcatagtttgaagtcttagatttaggtcattcatccattttcatttgatttggtgaagtgtgttgcttgtaggcaacagatccttgggtcttgctttttatccattcagctattctatgtcttttgattgcagagtttagtctatttacattcaatgttattactgataagtgaggccttactcctgccactttgttatttgttgtctggttgttttgtggtcttctcttccttctgtccttctttcctatcttcctttaaggtgattttctcagttggcacattttaaattcttcctttttattttctgtgtacctgttgtatgttttttagatttgaggttaccatgaggcttgcaaataacatcttataacccattattttaaactgatcacaacttaacatcgattgcataaacaaaaagcaaaaagacaaccaataaaaactctataattttgtctccccactttttaacattttgttgtttctatttatcttactgtactgtctatgccttgaaaagttattattttttatgggttcatcctttcatctttctatttgagatatgtatagtttacacactactattatactgttataatattctgtgtttttctgtgtacttactattaccagtgagttttgtaccttcagatgatttctcattgcttgttaacatccttttctttcagattgaagaactccctttagcatttcttgtaggataggcctggggttgataaatccctcagcttttgtttgtctgggaaggtcttaatttttccttcatgtttggaggatatttttgccagatataccattctagagtgaactctttttttttttttaatgcttcagcactttatgccactctctcctggcctgtacagtttccactgaaaagtctgctgccagacgtgttggagctccatcatatgttatttgtttattttctgttactgcttttaggatcctttctttatccttgacctttgggagttttgttattacatgccttgaggtaatttccttttagttaaatctgcttggtgttctataaccttcttgtacttaaactttgatatcttttgtttgggaagttatcttattatccctttgaataaactttccaccattatctctctctctctacctcctttaaggccaataattcttggatttgcccttctgaagctattttctagatcttgtaggtgggcttcattcttttttattcttttttcttttgtctcctctgactgtgtattttcaaatagtctgtcttcaagctcactaattctttcttctgcttgatcagttctgctactaacagactctgacgcattcttcagtacgtcaattgcattcagcagctcgagaatttctgcctgattctcttaacttacttcaattcctttgttaaatgtatctgataatattctgagttcctcctctgtgttaccttgaatttgagtttcctcaaaacagctattttaagctctctttctgaaaggtcccatatctctgtctctctgggattgacccctggtcaatttatttcatttggtaaggccatgttttcccagatggttttgatgcttgtggatattcatggatgtctaggcactgaagagttaagaatttattgtaggcttcacaatctggagttgtttgtacccatccttcttgggaaggctttccaagtattcaaagggacttggttgttatgatctaagtttgtggacaccacagccgtatctgcattatggggtaccccaagcccagtaacactgtagttcttgcggactcgtagaggtactgccttggtggtcttgtgtaagatccaaaagaactctctggattaccaggcagagactcttgttcttttcctttactttttcccaaacagagttttgctctctgtgctgagatgtgtggagctaggggaagggtgacaaaagcacccctatggccaccaccactggggactgcaggtctgacctgaagccagcacaacactgggtcttgcccaaggcctgtataattatctggcctatgttccctcaaggccctagggctctacaatcatcaagtagtgaagccagctaggcttgtgtcctttccttcaggacagccctgggcccaggtaggtccagagatgctatcagggaaccagggtctggagtcagaaatgttagaaatctactgagtactttattctactgtggctaagctggcaccaaaaccaccaaagtccttcccactcttacctcccacctttccccaagcaggtatctcttcccgtgttctccaccccacaggcccacggggagtgctgccagggcaccaccaatcaaagagcataatatttagattcaataaatacaagcagccattagccagtcaataggcactagaatcaataggtactaaaagaccaagaactcaaaccagcatgtcattttttaaaaatcaactcatctgtttgcatattgataggatatgaccagagctttcaaaataacttgaagtactttatttagaaagacaaacagaaaaaattttaaatgcctaactttttatgaagaaaaaacatcaagaaagaaagaggcttgaccaatcgggtagacagaagagccacttctccctgaagatgagggacttcagaagccacagcagattaaacacattgagcccactggaagctcttttctaaaagcaatcagataatggtacacagaatggctaacagatcagacaggcagttgaagtatttaaatgagagagagagaaaaaaaaaaaacctaagcaaagtgcagaatattgcagaagaaatacagcataaaaaagcaaaggtatcaggactgagagtttaactcttaccacacattaccctctctgagcctcagctttctcttggggagcctcaaaatcctgtgctcaagggattctcctgcctctgcctcctgattagctgggactacaggcacatgtgccaccacactcagctaattaaaaaaatgtttttagaaataggggtcttactatattgcccagctttaccagcttattagaagccagtgggttaagcattgacctttaactttggcttttcatctgctgtcaaaaaatagaactgcctaactacttttatacttcctgtgatacaagatgattgaggaaagacagggaaatgcaaagagagaggtaccaggaatagaacattgttaacagctggcatgccctgactcagggaatggaggggtatttagcctgtggatgctaaggatgtatagaatatttaccaattctcagagtctctaaggccttctgtgagttatccatggtttagacacatgtctggattaaagagttactgttactttcctctgctttcacataaaacttccttaaagctgtgacaacaattctggggtagagggatgaggttttatccagcagttgcattgctttctttctaaaagactttcaaatgcagctaaaacacgtggaggtagtacttccgaatgcatgtgagtgaatatcactttatagtttgcaaaacactttttatataattggttcttagaattacttgattcctggaatcaacattttttccttctgagattgtaagcaaaggtctggctcccacttctgaatccctcattcagctaggcagaattaacacatctttccccttcttccacttgtgctttcttgacctcaggatgacgaggtgcatcactgaacatccagcccccgaccagggacctattcagaagcacgaactgcaggctgtgtcccaccatggatcacattcagcccagactcagctccttctgcaaccctgccaaagagcctacgaatgacggccccatagcccaggccactctattaatgaagaagagtgcactgggacacttgaggagaacctgttttgtctcatgtttttgaagcaagagtaaaaaatggaatgcctcaaaatgctacaatccctctatattcaggtgagggagattcttgtaattctgtgggttatgacatgatatccattaaattataagaactatggataaaattattaatattttcaaaagacaatgttttaggaaatatcccattcaaatcagtaacaagggtaataaaatgccagtaataaacttaagaaatggggaagatggctgggcatggtgtctcacgactgtaatcccagcacttttggaggatcactagagcccaggagttcaagaccagcctgggtaacatggcaaaaccttatctctacaaaataaacaaataaaattagctgggcatgaaggcacacagctgtagttccagctactcaggaggctgagatgggaggattgattgatcccaggaggtggaggttgcagtgagccctgatcatgccactgcattccagcctgggtgacagagcgagaccttgtctcccaaaaagaaaaaaaaaaaaaagtgaaagaattgtgtaaagaaaagcataaagatgaatggaggcccctgaaagaagggctgatggggaaggacaccatgtctgtgggtataaggcatcagttacaaagacgttcaccttctcaaagtgctctagagcacgggttcccaaccccggggccatggacccgtgctggcagtggcctgtcaggaaccgggctgcacagcagcaggtgagtggctggtgagcaagcattaccgcctgagctccgcctcctgtaagatcaaagcagcactagattcccatagaagcacaaagcccattgtgaaccgaatatacgcaggatccaggctgcgcgcttctaatgagaatctaataccgattatctgaggtggaacagttttctcccaaaaccatccccactccacaccccaggctgcagaaaagctgtcttccacgaaaccggtccctggtgccaaaaaggttggggactgctgctctagagggttcatgctactccaaccaaagttccaaagagattttcttatggaactttgacacattgattctaaattttatctggaagagtaaatgagtataaattgccaagaactcacttaaaaaggaatttaattagtaaagtcttgccaaaaataaaaattaaaacatattccgaaactagagtaattatagaatgtggtactagcaactggtttaggaataaagaaaaggatcaaggaaacagaagaggctagaaacatatgatagatatgaatttaacataagataaaggtggcacttcacaacaggagacaaagaatgcaccagtgaataaattatttttaagaccactaaccatgcatttggaaaaaattatacccctcacaccagaaaagtaaatttcgggtgacataaggagctaaaatttaaaaatacaaaaaagttctagagaaaatatgtatgtaattacataatttggggttaaggaagacaatctaggaaaagaaaaacaccctgctgcttatgatccaagacccacgtcattttcaattccacacagctgtaaagcagcggctctcctatcagtttttccactggaatcacctggaaccctggtgaaaaacagattttgaagcctcatcccaaacctgctgaatcacctcctcaggtggttttgatgcctcgccatgttttggaggcctctggtctagggtcaatgccacagtggggaggaggtaagagaatgcaggtggtaaaactaccatagccttgacagcgatgaaaccccccaggtgctagtcacacaaaggcttaccttttgtaaagtcccctgggaactagtttcctatttattcaagtcagctgtattaaataataccctccctaaccaaaaacgccaaaaccacaaaacttcctaagttacatggtgtgttgcagcatggcaaaaatacatcctgatcagtttgcatttggtgttgcatcaaattatggcatagcccacaatgcttaaacatccatcaacagtggctctcaacctaggctgcttttaggaaccatccaggaagctttgaaaagtaatacagttgtgtctgaatccttttggtctaggatggtgcccaagggttgtcatttttaaaaagcactacgggtgaattttagctggataaagaccattggctatatgtcagaaacaacttctgctccttggagttcaatatcattttttttttttttgagatggagtctcactctgttgcccaagctggagggcaatggcacgatcacagttcactgcaacctccggctcccaggttcaagtgattctcctgcctcagcctctcgagcagctgggattacaggcatgcgccaccatgcccggccaattttgtatttttagtagagatggggtttcaccatgttggtcaggctggtttcaaactcctgacctcaggtgatccgcccacctaggcctcccaaagtgctgggattataggcgtgagccaccgcacgcagccgagttcaatatcttaatgagacacaaaagcttaaagggtctaacacaaggcagaacatgatgcatgaggtaagaacatttcaaactaggtgccatggacatatggaagaggaaggtgactatctgggaaggcttgggggtccaggggagggaattttgttgagcctagatctagaaactgatctaagacttggacatgatggaaggacacccaggcaaggggaaaaaaggggatcatttgaaaccttattaatagtaattattaattagtaattatttcattttcctcccataacttcccatataaacatcttaggtatatatgcatatgcctcctatattttttctatttgcaattataattttctaatgattttgtcatactgcatatgaaatggatataattatgtctttagcttctagacaaggctgtgattcctctagctcagggttaaggcagaaaagggtgtctttcctccactcccagtaatgcactattagcaatctaccatataaaaaagggtaaactgaacccactctattcagaaaatttcaactcacaaaccttctttaaattacccagcgagttagggaggaggatgatgagaaatcatcctcatccttgccaagaattttttcaaataagcaaactatcctgcccaaattcagtgaatgcattactaattaatttcgttctgtgatgtctgttctacatgatgatgatataactttctgcaaaacaaaaactgaggcactctacatctgccatccatccctccccaaactaggagatatgaaagtttgaggctgagcaggtcaagcagggatgtgtctgttttcttgaaccatttctaaccttactcaattatttccaactgaagcatttccttaacaggcaacatgcaactctttcaaagacaatctattaaaagactggagagaaatgatatcatttccctaaaatttagtgagccaggacttgaacaggtttgttagaaaaacactaatgcggtaactctattattgcctctaactttagggcgatgtggtagtcagaaaggaggggtggctagaacagagcctcagccacaaccaggttgtggtgcgttacatagtcccaatggtggtatctaaggcattttataattttcttattaattgtcaatacatcaccacttgaatgaaaagagaatggaagctattcttacttcattttttaacaaatgaaactgaagtacagttaagtaatttgttctactcagttccaggaaacaatgtggggaggagggcctccttccctgatcaccaggcaggctcctgcctttcctcagggtggaagagatccactgctgctgtctgctgactcaccttcacactccagctagaggatacactgactcacagtttcattaccttctattcaccatgactgtagtcgtagacactcagaaatgggagttccaagaactgagcaggagaaggaaaagaatgtagatgaaattgaaaaggataaagggtacagcctctatcattgaataaaccagaaaagacacaggagaatgtagtgtctgccctcagagactacatgcattactgagaggaaagtggggagaggaggcctgatccacagctaaccataattccccaatatgaactgccagataaccagggaatgtcgagagtgtacaggaatgtgggaaggccaaagggaaagatggtgaattctgaaaaatataaagaaatgtaaattatctctgatctcaagaggcttacagtctacttgggctgtaagagactgtgtgaaaacagataacaatgcaagatgacatagtttagtcacaaataaataactctatggtaagggccacaatttggagaagggaatgatctccacgagttaaatcagaggcttccaggaaatgagtctttatttgttgttgttgttgtttgtttggttggttggttttttgttttttgtcttttttgagacggagtctcgctctgtcacccaggctggcgtgcagtggcgcgatctcggctcaatgcaagctccgcctcccaggttcacgccattctccagcctcagcctccagagtagctgggactacaggcgtccaccaccacgcccagctaatttttttgtgtatttttagtagacacagggtttcaccgtgttagccaggatggtctcgatctcccgacctcgtgatcggcccacctcggcctcccaaagtgctgggattacaggtgtgagccaccgcacccggccttacttggttttttaaggattcagatgaacaggaaaaaagggaagggaaatctagtcacaggaaatggcctgaccaaggagtgtattctaggcagactataaaacataaacctgagaataagttcattcgttcattcaatcaatatttagtgaaaatccactgtgtacaagcactgtgctaggagctaatagcaggaacaaggcatgtaggctgccctcacggaatttatttgagaaggactactggaaaatagagttggataaatgcaaccagtaattggtttaatttagaccgtaatgcattttggtctttagactgttcccagtaggaactgagagtttttgaggaagagtgacagatgcaaagccgtgttactagaagatgattgcgctgatgctatttctgtgaattaccgggggataagagtgaagaccacttaagaaacgcttataatgttcccagtgtaagacaatgcacatccaaactagggtggccactgtgaaaaggaagggggagtcctgtgaagatatactcacaggacgttggaaatggcaggagcaaggcagggatgggaacaacagacaaagacactactgtctccagcatagatgcctgggggaattctaaaaggaaaaccaggtaggagtaaaaggtaaggtgcagttctccagcgccaggactggagtgttctgaaggctgggctcttttcaatgcccttctctattttcatgctattgatcgtccccattctggatctctttcttcctctctggcctgacaaaatctgttctcaccctctttaggagaaggtttgatagactagttcagagggatcagtaatgggagaaagtatagcatggacagcagccgtggaagaggcaccccgggttgataggttttccaagcatgctgtcggcaacagcctattctgtgcatctccttaaggatagctggactccctccagaattgtccaggagaaaagtttccctcgattccacttggaagaatcgctctttaatttttggttgagcaggataattagagatgattgagtcgcatatctgaaagcttgggatatttggcacgtccctaaccttggaagatgatatcctggagggcggccatcacacttcctctggggaagtgtccctgtgccgtagtgctttgcaatcatctagagaccttgttaaaacacagatctgcaatcaggtgtgggtgggacctgaagttctgcatttctaataatatcccagggatgcccacgctattagtccgtggacccacaacctaaatacgcatgtgtctagaagcaaacagctcctcttctaagcagaccttagattcagatgaccaggagtttaaatcccctctctgccacttttcagatgggtaaccttaaacacggtacctaactcattttcctcatctgtaaaccaaggaaaatactaatatgtactttaaagtagatacaaatgctggatgatatagaagtggtttcttagtaatcgctagttccaatagcagattctcttctattcaacagtgtgttaaactgttaaattcacggaagcatacccagcccccctcaaaggctctaaggtctgcagaaggaattaccaagaaagcaaagcacagaactccctcagaaactggaggagccattgaaaactctttatcaccatgtaatcctgtacaatcacaagcacttccgaaaacagcattatcctgtatttgtctgagtgatttataacgttaagatcgaccacatgatttcctagctctaaatttcccaaactccggtttgcagggaaaggaagcatttcttttctaaggaagtcagcacacctagatctagccaacggcagttgatttttaagtttcttcaaccttcacatttccctttctcaaaagttggatcccacctgcattaaaaactactgtcctagcacattacaaagttattcaatctaaaatgtcttgtttatactaaaattataaaaatgcatttaagccaggtgtagtggtgcgcgcctgtagtcccagctacttgggaggctgaggtaagaggattgcttgaccccaggagtttaaggctgcagtgagctgtgatggcaccactgtactccagcctgggtgacagatagagaccctgtctcaaaaaaaaaaaaaaaaagaaaagaaaagaaaagaaaagaaaaaaaagaaaaaaaaatccatttacaacacgaaccagaatagtcttatactggattctttgtcaaaggtgaagaaacaggccaggtgcggtggctcacacctgtaatctcagcactttgggaggctgaggcgggtggattacctgaggtcaggagttcaagaccatctggctaacatggagaaaccccgtttctactaaaaatacaaaaaaatagccgggtgtggtggcgcacgcctgtaatcccagctactcggaaggctgaggcagaagaatcacttgaacccaggaggtggaggatgcagtgagctgaaatcatgccattgcaccccagcttgagcaacaagagcaaaactccgtctcaaaaaaaaaaaaaaacaaagaaagaaaaaaacgcaaaggtaaagaaacctctacattttgaaaagcaaaccacagctctgtaaaagcgaaatttttgtcctgttaaatatcaccattcccttgtacacattaatcttttaactcccaaaacctaaagcatgtgaacataaataggctccaaaataatctagagtttgtgtgtacagatagaaaaaatgtgcatattttatttttaaaattactctcactttctctaccacacactaagaaaaacccccatttggagaaagccacacccttcactaacggctcgatcaacctttcaaaacaacatgaagggcaaacattaagagccattcaaaaccaagggaaatgacaatacagttgaaaaaagttctctgaatgtaaatgaagctactggaatttgtggggagcagaataaacaaaacaattaagccattagcctgtctcctttgagaccgtcctggcctttggaggagagcaataccagattcctctagcacaggtggatggcacgttggcttaaggaaaaacaaaggcagcaaatcctcgtctttaaaccagaacagacacaaccttggtcaggaaatttcacattctgaaagtccgtatcacctaacaaggaaaaccttcttatcctggccatgaatctagcagtgatctttcatatcagcaaaagcagcctaaccactcccccacaaacgtcagaaaagccctcgcttggggtcacaggcctgggtgtcctcaggtggcagaactcgaacagactgctgcctccatgccaggtgggcacctggcatgtgaacctaaatgtgataataaatatcaggctccaaaatggtgcccaggtgggcaccattgcaatggctctttgttcggagttgggagcttttgaacggatagtggtgaatttggtttccattttgacctggaaagagtagctccaccccttgtggggacaggtcaggactggttgtgtgatctcaggtaattataattacctagcctctcaattgaaggggcgttagtaggaaaggagtgagaaacaggtagaaaccttcccagcctaccagcttccctccacagctaccccctcctgcaggagccccaccgaaccactaatatcctgttctgtgaaaagaaaactcaaaaggaagccctagtggttttatctgagggggctacttttatctttgaaaactatttccagtttacaattagttgtctcctttaatccgctggctctcatcaatcactcattcactggcggctgccttgctgccaccaagttgaattggagggttttcagtcctctgggcacttttggtctagtggggaacagttgttcaattcagcaaagttgccaattctaccccatgccagaaatacaaacacaaaccatgagcatgacagtgtccctctccgtcgtgactttccaaccaaggaggatggaataataaatattaaaaatatcactcaaaaacttccaattggcaggagggccccaatttaccttgcctgtctcaactcctccattccttgtctacaagccactggcaattcctccttccaaatgttctaactggtggtgatctacatatctttccagatactacaggttacctactcctgccactcacgtgggaggctatttcttttacccttctgtagagcttaggatacttcacccagccacctggagctggaaatggactctaaaaagctcaaaaagtgcaaatctgccaatttttcacttgagttccagaacaaagattttatgcgcacagtttgaccctgccagtcttagtttcactaagcattttaaacatccaaattcaacctgtccttcaaaaccacatgcaattttaaaaagcaaattgtctaatgcgcaatcccatggcaattctttcgattcctttttccatctcttgtatttgcctatttcttttttttttgagacaggctctgactctgtcacccaggctggagtacagtggcatgatcagggctcacggcagcctcaacctgccaggatcaagcaatcttcccacctcagcctcccaagtagctggaactacaggcacacaccacgatgtctggctaattttcgtttatttttttgtagagacggggtctcacaatgttgcccaggctggtttcgaatgcctgggctcaagcaatccacctgcctaggcctcccaaagtgctgggattataagtgtgagccaccacgctcagcatatttgcctatttcttaggcatctacacttgtgaaaatcactggcaacatatacaacagattctgttttctaggagaactaccttttgttaaacagttgcacggggaaggcgtttgccccattttcaacattatagctgctgctgagtgaagaaaggcatcatgactgcagattgctttctactgccttccagggacaagccacctggctttcaggtgcccttttaagtgtctttttatcacctgtctcctctctgtcctcaccattccatctttccgaagggcaagcacaacggagtggggagtgacacacatcagacaaggttccaacgaaaatgaaaggcttgcgacattcaaatcacagggtgctttcacctattcattcactcctgttcattctatcagctgagtacccacgagcagcagttttttggagtagattttaagaatgctccaccttgtaggcagttctgcatcctacttttgtccctcaaggaaaagacctgggggtagttttaaagattgtatactgatgcataacaaaaagaaatacaaacatttttcccattaagttttttggggttttttgttgttgtttttcctgaaacagggtctctctctgcaatctcggctcactgcaccctctgcctcccgggctccagcaatcctcccacataagcctcccaagtagctgggactacaagtgtgtaacaccacaaccggctattttctgtattggcaggtctttgccatgttgcccagactggtcctgaactcctaagctcaagggatctgcctcccttggcctcttaaagtgctgggattacaggcgttgcaccactgtgccctgcctcctgttaagtttttttttttgtttgtttgtttgtttttggttttttttttttgagatggagtttcactcttgctgcctaggctggagtgcaatggcacgatctcggctcactgcaacctccacctcccgggttcaagcaattctcctgcctcagcctctcaagtagctgggattacaggcgcccaccaccacacccagctaattcttgtattttcagtagagatgaggtttcgccctgttgaccaggctggtcttgaactcctgacctcaggtgatccacccacctcagcctctcaaagtgctgggattacaggtgtgagccaccgtgcctggtcctctcattaagttttaaaatagtatcatatactcaagtattggaagtcaagaaacaacgaggggaggtgggaatggggagaggagaggctgggatacaaagctgaacgagaaaggattctacctgaaaagtaactgatcagaaggaaagacaaaatgcacattagcaattataagatctttatagataaagtgctcatgagattttgaagaaggagataactttttttttttttttttgagacgagtctcactctgtcgcccaggctggagagcagtggtgcaatcttggctcactgcaacctccgcctcccgggttcaagcagttctcttgtctcagcctcccgagtagctaggattacaggtgcctaccaccacgcctggctatttttgttgttgttgttgttgttgttgttttgtatttttagtagagacagggtttcaccatgttggccaggatggtctgaaactcctgacctcaggtgatccacctaccttggcctcccaaagtgctgggattacaggcgtgagccaccataccttgccaaggaggtaattttcaatgatgaggctcaagaaggcagagttaaggctggtttaaaagaagaattagactgacgggatggagagggggaggaattgattccagccagacacaagctgaagatggagaacatctaagcctgaaagggaaacaccaagtggatgaatttggtcagctgatataggtgagtgtagccacactgcagaggtggaatcacaggacttggcaagtggtagaatgtcacaattcactacatcttaattggagcatataaaattcacttttgtcaactgacacttaaatacaactgctgcaaaaaactgaagactcttgactcatagccccaaacaaagaggatgatgtctccttgtctccatagagcagacaatgcttgccacattgtcctccatgcttgcttggagagttgctaagcagggctggaccaaggagtatcaagagagccttagggaagaggaggaggaggacaaaaaggagaaagaggaagaggaggatgaggaggaagaggaggatgaggaggaggagagagctccctttggtttactggccttacttatgtttcctcacttctcagcaggtgcaaactatgtctcctgccttctccagctctcctcatcctttccaagtccagatgaatgcttcaaggagaggatggacaagaggccttgtggggaaagaaaaggacactagttggaagatgggtttggggtgtgagggtgtgtgagagaaagagctagaaggaaaaggccatcccagtttttctacaccccaagccctagttctagatcatagaaacaaagcacagaaatctgctccagagtccagatattaaggcccagcaatttcttatgtcaactattaaatactaattttctaattaatatcaatgtatcctcaccaggaaaatgggttttcaattatttatataaagtaaaaactttatgtccctgacatatttatttggagtctgtattgaatgcatttctctttgtgatcacagaaaaatttaccactttgaacctctcttctaatacaccattatgtttgattttcaaacatttccagtaaaagcaggtttacgaccataattcctgaactgtgggttaagagacttgtattctagggacaactctgctattaacttgccaagtaactgagagacctaggtcaggccaccacagttccctggaccttaaagggtcacttggggagaccatgaaccacattggggatttatgaatctttttcccaggaaaaaattcacttaagaatgaatatggacacaaacaatttcatagactaccctggaagtggtctccaggatacttctcatcttgacattctatatttaaagctatttggtcactgaaagaaacaaggttgggcacagtagctgtcacctataatcccagcattttgggccaccaaggcaggagaatcgctggagaccaggagttctagactagcctgagcaacaaagtgagaccctgtaaaatatatatatattttacatacatatatatatatatgtatgtgtatatatatataatatatatatatatttttttttttaattagctaggcatggcagctcatgcctgtagtcccagatactcaagaggctgagatgggaggctctcttgagcctaggaggttgaggctacagtgagacaagatcacaccactgcacttcagcctggatggcagagcaagaccctgtcaaaaaagaaagaggctgcatgcggtggctcacacctgtaatcccagcactttgggaggctgagataggaggatcacttgaggccaggagtttgagaccagcctgggcaacacagcaagacctcatctctaaaaagaggaagaggggaagggaggcagggagggagggatattattttccatagccattaccatgatacatatgatactgcctaggtagagctgggactgtagggtggggaaccaatgctgtcctgcacactgagactatgaatgccaagatatcactgccagatccttctgtggatgaggctgggccaagcttgaagaagtcccctcagtggctggagatgcctacagcgttctataaaacaaagccactcctattaaaacttaaagggaagctatttgctttggttctctgagtatatctcttctttcagtccaatgagcagttagtgtctagctttgctctatgtgaaagccaatataatatggagatatttatggatgaaatggtatgctatctaggatttgcttctaaagaaaccaggggaagataagaacagtgaaatcaagattggtcatgagttgtcaacggctgaagttgagggatttgttttctctccaacttacttatttttacatttttgattgaaagacagaacagaaagtcaaagtgaaagatcaggaggtcaaggaatttttcacgtcctgtacaagtcctgggcacgaagctaaactaatcctactcgattcacgtcttgacgagcccacagatagcaaaatctgtggctcacagaatatggaattgacacagggttattttgagaaccatcttacagtccaaaagacatgactttcaaccaaggggaaaaaaaaaagaatttttgtctgtgtgtggaatgtctttcttcacatggacagctcagaggtgggcgaaaatgcagaattgggcagcaagaagtattgtccccaccttggaaggcctgcattcccctttctgtccagcaggccatcgagcccagcatggtttggcatgattcattgctctctaactttggacttaatgtaaaatgtttgttattcttgtaaagcaccctttagcagatagaaaatgattttccttcttgttgttagcttctgtttttgccctttttttcccccaacaaaagacagcagttttagaatgagactgagcctcatcactacaaaaggacttcagctccgattcctcatgccttgcttgggaaagcagcagcagacagagcaggagccatgctggcttctgtcaaacaaaggggttcaggggatcagccagagaaaactggagctaccactcaatctattcctgcctccaagtattcccgcaatgtaggaaagttgacagaaaaggttgagggtagggaactgaatctgagcctttgggcagtcctcttccacagtgactctggacttgacagtgtgacttgcttcagccaatggggataatagcaagcatgacgcaagcaagggttgaaaaatgtgtgtgccctggagcttgtacccttgcttttcttgggaaccctgtggtgtgaccactactatgtaaacaagccagagctagactgttgtgacaagagacacatggccaagccatcccatggccccagctgagactggaccaactaccagacatgtgagtgaggccaccctagatcatccattcccagccaagccactagctgaccacagtgattgaatgaaccagctgagaccagaactgccacgccagtgcacaaaatcataagaaagtataaacatttattatttaagttactgagtttgggtgattggtcacaccaaaagctaacacaagaaaaggtggctaagcagagctaagatgtattgaacattgggagacatatcccctaatggctctttacacaatagtcagtgggactcactattgatgcgactgtatgtcaactgtcattgaaataacctgacatagatccaaaattgaccatactccctaatactcatttcaagacaatgttagttgtaattcttggaatgctactgtatgggcttcaggggtttataaacctcctgaagttaaatgaagaattatatgtattttttcatctgaactgagaaaagatgttaaaactacagaggataacaaagaaatatatatgtacaactgcctagaattaataatatctcatcatatttgctttggatttttctatatgtaaagcaaataaaacattactgactcagtcgtctccctttcctctttcccccttcagtattttgaacttggtgtggatctttctagtctgtggatttttttaattaatttattaattaatttatttattttttgagatggagtctggctgtatcgcccaggctggagtacagtggaatgatctcagcttactgcaacctcctcctcctgggttcaaacgattctcctgcctcagcctcccgagtagctgggattacgggcgtctaccaccacgccaggctaatttttgtatttttaatagagatggggtttcgctatgttggctaggctggtctcgaactcctgacctcaggtgatccacccgcctcggccttccaaagtgctaggattacaagcatgagccaccacgcccagcctatattttttaaaataatatccacacaaatacatatatgtacacatacacaaataaatgtatagacccccaaatagcagtcttattttgtgtttttgacatttttcttacatggtttcagatatgcgtctttctacaacttgcttctttaccaaacactacccttgtgacacctatgcatattgataccatattatcaaacaagccacatgtatttctcttccaatgaacatttagattgttcctgttttgtttgttctcgtgatctgcggaatgtttatttgttattataaacactgtcagggaaaaggtcagtagcttccaacatattctcagaggactcaggacattctcccatccaaatgttaggaatctctgataatctgatgtggagaaagggcactgtcatcattttgcattgatgcatatttctgcattacagcattcccaagccttgaaggaagctatctttacttacattcttaaaatagcttattagattcttctgcatttaaatctaaaattttctataaggtctgcatcttcctaggacaccaaaaacagccctattattttttcattgaaaatttcttagaatcagataatactgtccaaaatattctgtgaccatgtaatgttatcctaaattgctgtcaacatcaaatggtggtcacaccgaagaaattattaggagactaacaatgtgatattctaattttgttgttgtattctgtaatgtatttaagaattaaacaactaaatctctgttgttctcacattttcctattttctattttttttaatcctagttaagattagagagccttctagtatgactttctttttttttttttttttgagacggagtctcgctgtgtcacccaggctggaatgcagtggcacgatctcggctcactgcaagctccgcctcccaggctcacgccattctcccacctcagcctcctgagtagctgggactactggtgcccaccaccatgcctggctaattttttttgcattgttagtagagacggggtttcaccatgttagccaggatggtctcgatctcctgacctcgtgatccacccgcctcggcctcccaaggtgctgggattacaggcgtgagccaccatgcccggccagtattactttcttttacttttatgcttgctctcactatgacatcttctagtctctatggcaaagtcccaaagcaaggaaattaaaactcagaacactactactcataacagacaatgttcttaagtctaaattatcccctctggtattactgaataaaatcaaccaaaattggtgattttctatcagccttaccttccctcaggagtatgtgaaataatgaaaaagtatacaaatacgtggactcggcattgtcaaatttagaaataatttattgaaccacttttcaaagagcatggacttagcagatctggctggtcacatacaaattgtgtggccctaagtaattcccctcccctcactacactttgattttcttacctgtaaaatggcaataaaaaccaacactggtgctagaatgaaatgaaatcatgtatatggaagccttttgttatcatttctccactatatggggagcttctcataagcagaggcagagagactaattcatctttttggagacggaatcttgctctgtcgcccagactggagtgcagtggcaagatcttggttcaccacaacctctgcctcccatttcaagcgattctcctgcctcagcctcccgagtagctgggattacaggtgcccgccaccccacccagctaatttttttgtatttttagtagagacgggggttttgacatgttggccaggctggtctcgaactcctgacctcaagtgatctgccctcctcggcctcccaaagtgctgggataacaggcctgagccaccatgcccagctctaattcaccaagcctgtatgctaacctcctttgccatggcaatgtcttctctccactttgaggttcaaagctctccatctccatccactcccgttctctggtaagaccactcatatttgccaaggaagacctagaggtctgagtacccactggtgtcacatatttgagtgtcaacgccagaatccagggggagcaccaatggtaggtacctttgggctagaacctgggaatgtggagtatgcatcccaagctcacccaaagagggggcttcttatctcaggagccaaagattaagcagcccattactgaccacagcggttctagtgggtggaaggaggaactctcccctgtacacacttctggaggaagtctccatacagttatgacacacagtgagtaatccggctacatgggattataatactgccaccaaaatataacaaatatgcttatcaagaaaaaggatttgtaaaacaagtggaaaaataacagaacacaaattgtatatttgccccataattacaaccacataaaaacaatgtgtttgaggcccggtgtggtggctcatgcctataatcccagcactttgggaggtcaaggtgggtcacttgaggccaggagttcaagaccagcctggccaacatggtgaaaccctgtccctactaaaaataaaacagttggccgggcatggtagtgtgtacctataatcccagctactcaggaggttgaggcaggagaatcgcttgaaactgggaggcagaaggaggttacagtgagccgagattatgccactgcactccagcctgggcgacagagtgagactccatctcaagaaaaacaaacaaacaaagaaacaatgcatttgaacagactgaaaggaaacccagagacaaaaataattactgtgttagggtgtgggggtactttgggtgaattattctaaatttctttttctttttttttttcttttttgagatgtgccccaggctgtagtgcaatggtgtgatctcggctcactgcaacctcggcctcccaggttcaagcagttctcctgcctcagcctcccaagtagctgagattacaggtgcctgccaccacactcggctaattttttatttttagtagagacagggtttcaccatgttggccaggctggtctcggacttctgacctcaggtgatccctccacctcagccttccaaagtgctgggattacgggcgttagccaccgcgcccggctgaattcttctaaatttcttataatgaagttagtacagtaaccttccacctacaagcagactttcttgaaaagtcccagaaagaaaactatctggtcacgtccagactcttaaagaattattcccaccactgtttggtaagaaaaaccttattagactgggatctaataaggttagatctgcactggatcagatctaacttggattctggcaccagctcagctaaaaactagctatgagactttggaagtaatttaacctctctagatctctctgtgaagttaacaaatggatttaggatagaatttttaagctctcttctgggctttctacaatgtagcctatgttttactttctataatgtaacgtatgaccataaagtgctataaatgaatttgtaacaaacattatcagagctcaaaagacccaagagagtgtgcctccttcagagcagttcttatacttattccaggaaaaagggacctgctggatactgcatatctttagtggggctaattgttccgcctttgaggcacaatgtaacttctggaaacacctgagagggatgtaatacaaagtctggtgagtaataggaatgatcacactgggcactaaggagttaaaaaataaaaaataaggccctccctccttccctcttcttcccttctttctctcttttgagacagagtttcactcttgttgcccaggctggagtgcaatggcgtgatctaggctcactgcaacctccgcctcccaagttcaagtgattctctctgcctcagcctcccaagtagctgcgattacaggcatgcaccaccacacctggctacttttgtatttttagtagagacggggtttcaccaggttggccaagctggtctcaaactcctgacctcaggtgatctgcccacctcggccccccaaagtgctgggattacaggcgtgaaccacagggcccagccctgtctctttcttttttttctctctctctctttctctctctctctctcactctcacccaggctgcagtgccacagttacagctcactgcatacttgaactcctcagttcaagaaatcctcccacctcagcctcccaagtagctgggactatagtgcatgacaccacacgtggctaatttttaaaattttttttggtaaaggcctgaacgaccacacccggcaaaaaaataggttttattacatagctcataaatgaccattcaaaagtgctttgaacaacggcaatgacgtcattctcatggtggtaactcagaagggcgggccaacttcattcacatgtacagtttgagttctatgggttgtcaaagttcatgtcactatgttagggctggcttttacagttgtacttctcttaagtgtggctgtcccaaagatatatgaaaaaaatactttgctaggatgccccaaaaccttttgtctctgccaacataaattctgaaactgaaattcaaaacacaatttgtttaccactattacagaatgtgcttataaggctgagatgtttattttaatacctttggcatttaacctttaacctcttatttactttgtaaatatttcagcatggtgagaaaaagaaaaaaaaagtttttaaaaactcaccattaagaaacattttaatcacagattggtaaaaacacaagttgctgcattttcgcaaaaaaaaaaaaaaaaaaaaaaaaagagatgactcaaacttggaaaaccatgactgtacataattcctatatatcctaccatgaagcttataataccttgcacttacacagaagatttaaaatatttctgcttgttgaagcagataaaaagagatttctcaaattcctaatgaataataaggccccacacttggctcatgaggaaacgcaaggtactatatgttctttcactgagtctcacaggggctcatcacatgcccacactaggcacagaggcaaaatgttgtattctaagttatcagaatgcacgccgctgctcattatctaaccctcaggaaaacgcctgagacagaccgccaattcatgagattcaactgaaaaaggagtgaaaaacaagaagtccatcatgtgacattggaggccatggcattttcagtggaggaaggagttgaagggttgaagagaaaagctcaatttgcagcctcaccactcgtggaaccatcctacacaggtgttgagatagcgccaaacagtagcagctggatgcagattttccctgttataatagcttagagaatgcataggctgaaaataccaggctattccctctctttagggagacccagtaggaaggtgtggatgtatggataaatactgaatgccactactgggtatgcagtgaacgtttagacattcttcctggtgagtgaatgagaagaatcactgtggttcacagaaggacaccatgttaagacttacaataaagtggctgcaaacagctaatctgcagctgtgtttggcccctctgagatgatcaaatcacatataaaaattggcagaggccgggcgtggtggctcacgtctataatcccagaactttgggaggctgaggcgggcagatcacctgaggtcaggagtttgagaccagcctggccaacatggtaaaaccctgtctctactaaaaatacaaaaattaggcgggtgtggtggtggggcctgtaatcccagctactcagggggctgaggcaggagaattgcttgaacctgggaggcagaggttatagtgaaccgagatcgcgccagtgcactccagcctgggcgacaagagcaaaactctgtctcaaaataaataaaaataagaactggcagatatagcataaaaatctagatttctagtttctcttgaaaaacaagataatttggtaatatggtcgatataaccatggcctagaatcaagtagtggtgcctcctagaatggcacatatattccatatttactctctagaggccagcctccctccaccaaattataagacatttaagtttgcaaccactggccgggcacagtggctcatgcctgtaatcactttgggaggccgaggcaggaggatcacgaggtcaggactttgagaccagcctggccaacatagtggaaccccgtctccactaaaaaatacaaaatattagctgggcattgtggcaggcacctgtaatcccagcactttgggaggccgaggcaggaggatcacgaggtcaggactttgagaccagcctggccaacatagtggaaccccgtctccactaaaaaatacaaaatattagctgggcgttgtggcaggcacctgtaatcccagctgcttgggaggctgaggcaggagaatcgtttgaaaccgggaggcggaggttgcagtgagttgagatcgcgccagtgcactccagcccgggcgacagtgagagactccaactcaaaaaaaaaaagtttgcaaccactgacaagactgtagtcctcagcaaaagtgtggtggaggtgactttcaacttcagtaaatgtctgcttcttatacttctccatccctctccatccactgctccacccattttctctccaaggagatgcctgggctgtcaaatatttcccactaggatggcccactcacacttgtccctagataatgtcccggactctaggtatttccccaacgctttgcctccatcaaaactttttttgtgcttgatcccattcctttctggttttgttttgttgtattgtgttgttttgactaggagactactagcaatctgataaactaatctgtggaaatcaagtaggttaccttcccaggaaacatttgaaatgtattccagactttctaaatacatgccatgccatcacctaaaggaacttacctaccttatcatcagctatccatcagatttctaggttgtaaatctattcctgggtattcttatgtgtcatatctataatttcctcacaagtatatgcaagtaaggaaaagggaacagctcttgaacatgttttgaggtgatggtcaattcagatttgctcaaatatttctgtatatttaatgcacagaaaccttgcataaaaatcaatcacaatttctggatccaaagcacatagcggacctacagccatgggtttcagtctatcagagagtccaaactggtcatggccacaaaagcagaacttcctttgcagatgatgataagcccagattctacgaaggaagccttagatgggtattacggttaaagtcaacagagatttttttgtactctgctaaacaacctccactaaattataaagatgtgcagggttttttttaacttcttcaagtctccttaggaaaaagacacaagtaactattgcctggtagtgttcctagttttctcaagatagaaaagtgtcccaaagtgagttttcaggaggaagatagaaggtgaactacaagctgtacactgtgttcatgagtcagaaaatgaaaatggctattttccttatgagtcacaactgaatgagtcttagtagggcctcaggtacagatggagagccctcctactatgctaccagacttcctaaaagacacacgcacacacacacactcacacagaagaagtccacggtataggtgttctccctatagcccagccaagggccttctttttcttcttcttcttcttaatattttttaactgaaacagggtctcactatgttacccaggatggtcttgaactcctgggctcaagtattcctcctgcctcagcctcccaaagtgctgggattacaggcgtgagccactgcgcctggccgccaagggccttctgatgaattttagcctccatgctaatcttcagccacacccaaagaaggtaatgtcctttcccttcctgttctaagcagctgaagggatacaacttgggcaggcctgggcagatgtggaacacaaaatgaagtatcatttggcttgacagagtctgacataaacattaaatattgtaacttgggtttctgattatttaagatgatgctctattctaaggcaacttcacatacataatgaacaatttttcaagtcaggaaagaaatgattaactttggccaaatcactctggatccagtagatctatcaatggcacatctcctgtttcaggacagccagctgtttcaacttttccatcagtgaattgtgacttcagcaaccatatctgatgcacagatagtcgcctgggggcacacaacatgcccatctgtgctgatggcagggagcccatcaatagggaagtcacacactgtcctcagatagaaccacctcttccctacagcatgccttcttcgcatgcatttgaccaaccctctacttcatctgcaatggggctgaattaagcatggtatcacaggtttcggaaaaggcaacctagagtatatttcagtccattcagcatgaaaaatgagtttaactgaggggaagttaatttcctcaaggtaccactcaagtacttaaattcagtaagattctttaagttcttgacataaacacattgatttttttaagaaatattgacccacggaaaatgattacagcaattctcaagtaccaggactatcacactgcttcaagggaccaggtgcccagtgaggtagcttcacccaaacacatgcccaatgggaatggttctctgctggggtgagggaaggggtccaaaagtaacgtagagtagactgacttcttaaaccttaaaactagaagaggaaatgtatagacaaagtgttctcttagatggggcaaaagtgacttaattttggactatgtaaaaagaaaaggctttggccgaggatgccttgaaaggtttctcgttgatgtttgtttgtaatcattctttggaataaacagcacggggcaagggggcttctgagctttgtgtgcaggtttcgatgggcctctgctgcacttccctcaggctgctcaccgggatatcgattttttaattagtgttgtgctggttatcattttgacttggcttctcttccacagccattagaaaacaacagcaaaccagaagaggacgagataatccacctaagcaggactacttgaaaagaagcaagtgtggaaactatgaagccttgtaatagatttttttttttttgatgaactgccgatctcttcaaaatagagtccttgctttcgtgccccgcaaagaaaagtacaccacgccaaagcccaagggaggtggctaaggttatacagggagggaggggagtgtagctggactggggagttggaatagcagaaaagtcacaagtcaaagaggcggccccttccacacattcccaaagtgccaaagggaaaacagcaacaaactcgaaactcgcgagggcgtcttcccgtgcgaagcgtcccctggatccccgaaaagccccgatcccctcgcgcttgggaaggggtggggtcctcttcaggaggtgtttacttggcgtccggggcgcggagaccctcggggccggcgcccggcacaggtccggggcggcgtggttgccgcccgcgcccgagtctccctggctcttgacagcccgccggccgccaggtgctcgccctacctggcgcccccgcctgcctttgtgcggcccgcgccgcccctcgccaaggcgggccagggaccgcccccgcccgcgtgccgctgccaggcgggacagctgcgggcgctgccgggcagcggagcggcggcggggaggagagggagtcggcgcgagggtgcccggggcggggcgggcacggccgcggggagggcaggggacgccgccagcggctgcggcgcgagtctccgagcacctcccctgccggctgcgccccccacgtcccagcaggaggaggggaccccctcccgcgccgtgcccctcgcagccgatgcgcccacaccctggcttccgacagctggcagccatagcaacccggccacagaaagtttcgcgacgcagaaaccgacttggaataaagttttccttggcccctcgctcgctctcccccggcccgggtttacggaaagcggcaggaaatcagagctcgcgacgtgccggctcccgcgtccaccttctccacccctggccccggcagcgcgcccaaggtgggtgcaccacgccggggtttcctgccccgtccccgggtccggcgtcctaggacgcggcgcggccaactcaccatggtgactcgcgccgcggtcgcgtcttcgccgggtcccgctgccggggaactggggctggaacgcagtcttctgggcgaacttcaaaagttggttcccctcgccaaaaacaggctcccgacacccaagcactcacaggagccaatgggaacccagaggggactccatccaggcgggattggcggtgctaggtgagggcgagacggcggcgacttagcaggcggggcgcatgctgcggagggcaagagtccactcgtactcgccggtcgccgccggcccaggtgagtccgatgcgctcggagcgtccgcctcgctcccctgcctcactcctctttcttcggccacttaatccgtactcctctggctgagtctcg
